(12) United States Patent
Goldstein

(10) Patent No.: US 10,525,119 B2
(45) Date of Patent: Jan. 7, 2020

(54) METHODS AND COMPOSITIONS USING HIGHLY CONSERVED PNEUMOCOCCAL SURFACE PROTEINS

(71) Applicant: Boston Medical Center Corporation, Boston, MA (US)

(72) Inventor: Richard N. Goldstein, Cambridge, MA (US)

(73) Assignee: Boston Medical Center Corporation, Boston, MA (US)

(*) Notice: Subject to any disclaimer, the term of this patent is extended or adjusted under 35 U.S.C. 154(b) by 0 days.

(21) Appl. No.: 15/939,850

(22) Filed: Mar. 29, 2018

(65) Prior Publication Data

US 2018/0280493 A1   Oct. 4, 2018

Related U.S. Application Data

(60) Provisional application No. 62/479,848, filed on Mar. 31, 2017.

(51) Int. Cl.
| | | |
|---|---|---|
| *A61K 39/09* | (2006.01) | |
| *A61P 31/04* | (2006.01) | |
| *A61K 39/00* | (2006.01) | |

(52) U.S. Cl.
CPC ............ *A61K 39/092* (2013.01); *A61P 31/04* (2018.01); *A61K 2039/575* (2013.01)

(58) Field of Classification Search
None
See application file for complete search history.

(56) References Cited

U.S. PATENT DOCUMENTS

| | | |
|---|---|---|
| 4,912,094 A | 3/1990 | Myers et al. |
| 5,057,540 A | 10/1991 | Kensil et al. |
| 6,113,918 A | 9/2000 | Johnson et al. |
| 6,207,646 B1 | 3/2001 | Krieg et al. |
| 2010/0021498 A1 | 1/2010 | Weiser |
| 2010/0196410 A1* | 8/2010 | Choi ............... C07K 14/315 424/190.1 |
| 2015/0374811 A1 | 12/2015 | Malley et al. |

FOREIGN PATENT DOCUMENTS

| | | |
|---|---|---|
| WO | WO 90/14837 A1 | 12/1990 |
| WO | WO 92/19265 A1 | 11/1992 |
| WO | WO 93/13202 A1 | 7/1993 |
| WO | WO 99/45121 A1 | 9/1999 |
| WO | WO 00/18434 A1 | 4/2000 |
| WO | WO 02/098368 A2 | 12/2002 |
| WO | WO 02/098369 A2 | 12/2002 |

OTHER PUBLICATIONS

Altschul et al., "Basic Local Alignment Search Tool," *J. Mol. Biol.*, 215(3): 403-410 (1990).
Bouchet et al., "Molecular Genetic Basis of Ribotyping," *Clin. Microbiol. Rev.*, 21(2): 262-273 (2008).
Briles et al., "Immunization of Humans with Recombinant Pneumococcal Surface Protein A (rPspA) Elicits Antibodies That Passively Protect Mice from Fatal Infection with *Streptococcus pneumoniae* Bearing Heterologous PspA," *J. Infect. Dis.*, 182(6):1694-1701 (2000).
Croucher et al., "Rapid Pneumococcal Evolution in Response to Clinical Interventions," *Science*, 331: 430-434 (2011).
Fraley et al., "Liposome-mediated delivery of tobacco mosaic virus RNA into tobacco protoplasts: A sensitive assay for monitoring liposome-protoplast interactions," *Proc. Natl. Acad. Sci. USA*, 79(6): 1859-1863 (1982).
Giefing et al., "Discovery of a novel class of highly conserved vaccine antigens using genomic scale antigenic fingerprinting of pneumococcus with human antibodies," *J. Exp. Med.*, 205(1):117-131 (2008).
Kaufman and Sharp, "Amplification and Expression of Sequences Cotransfected with a Modular Dihydrofolate Reductase Complementary DNA Gene," *J. Mol. Biol.*, 159: 601-621 (1982).
Kuby, *Immunology*, 2nd ed., (W.H. Freeman and Company, New York, 1994), pp. 94-95.
Navarro-Torné et al., "Risk Factors for Death from Invasive Pneumococcal Disease, Europe, 2010," *Emerging Infectious Diseases*, 21(3):417-425 (2015).
Neumann et al., "Gene transfer into mouse lyoma cells by electroporation in high electric fields," *EMBO J.*, 1(7):841-845 (1982).
Petrovsky et al., "Vaccine adjuvants: Current state and future trends," *Immunol. Cell Biol.*, 82: 488-496 (2004).
Potter et al., "Enhancer-dependent expression of human κ immunoglobulin genes introduced into mouse pre B lymphocytes by electroporation," *Proc. Natl. Acad. Sci. USA*, 81(22):7161-7165 (1984).
Shen et al., "Gpos-mPLoc: A Top-Down Approach to Improve the Quality of Predicting Subcellular Localization of Gram-Positive Bacterial Proteins," *Protein Pept. Lett.*, 16(12): 1478-1484 (2009).
Tettelin et al., "Complete Genome Sequence of a Virulent Isolate of *Streptococcus pneumoniae*," *Science*, 293: 498-506 (2001).
Urlaub and Chasin, "Isolation of Chinese hamster cell mutants deficient in dihydrofolate reductase activity," *Proc. Natl. Acad. Sci. USA*, 77:4216-4220 (1980).

(Continued)

*Primary Examiner* — Oluwatosin A Ogunbiyi
(74) *Attorney, Agent, or Firm* — Leon R. Yankwich, Esq.; Thomas R. Berka, Esq.; Yankwich & Associates, P.C.

(57) ABSTRACT

Cold spot genes of *S. pneumoniae* are disclosed that encode surface proteins that are universally conserved among known strains and have exceptionally low incidence of allelic variation. Cold spot polypeptides encoded by the genes that are antigenic on the *S. pneumoniae* cells on which they are expressed are candidates for immunogenic compositions capable of eliciting antibodies able to react with all or nearly all strains of *S. pneumoniae*, thus providing an improvement over currently available *S. pneumoniae* vaccines that protect inoculated individuals against a maximum of about 23 of the 94 or so known serotypes of *S. pneumonia*.

13 Claims, 1 Drawing Sheet
Specification includes a Sequence Listing.

(56) References Cited

OTHER PUBLICATIONS

Watson et al., *In Molecular Biology of the Gene*, Fourth Edition (The Benjamin/Cummings Publishing Co., Inc., 1987), p. 836.
Wong et al., "Electric Field Mediated Gene Transfer," *Biochem. Biophys. Res. Commun.*, 107(2):584-587 (1982).
Yu et al., "PSORTdb an expanded, auto-updated, user-friendly protein subcellular localization database for Bacteria and Archaea," *Nucleic Acids Res.*, 39 (database issue): D241-D244 (2011).
Zhang et al., "A Greedy Algorithm for Aligning DNA Sequences," *J. Comput. Biol.*, 7 (1/2): 203-214 (2000).
Zhou et al., "LocateP: Genome-scale subcellular-location predictor for bacterial proteins," *BMC Bioinformatics*, 9(173): 17 pp. (2008).
Daniels et al., "A Review of Pneumococcal Vaccines: Current Polysaccharide Vaccine Recommendations and Future Protein Antigens," *J. Pediatr. Pharmacol. Ther.*, 21(1): 27-35 (2016).
Olafsdottir et al., "Novel Protein-Based Pneumococcal Vaccines Administered with the Th1-Promoting Adjuvant IC31 Induce Protective Immunity against Pneumococcal Disease in Neonatal Mice," *Infect. Immun.*, 80(1): 461-468 (2011) (doi:10.1128/IAI.05801-11).
Pichichero et al., "Next generation protein based *Streptococcus pneumoniae* vaccines," *Hum. Vaccin. Immunother.*, 12(1): 194-205 (2016) (doi.dx.org/10.1080/21645515.2015.1052198).
Sham, L-T et al., "Recent Advances in Pneumococcal Peptidoglycan Biosynthesis Suggest New Vaccine and Antimicrobial Targets," *Curr. Opin. Microbiol.*, 15: 194-203 (2012) (doi:10.1016/j.mib.2011.12.013).
International Search Report and Written Opinion, dated Jul. 26, 2018 in PCT/US2018/025127.

* cited by examiner

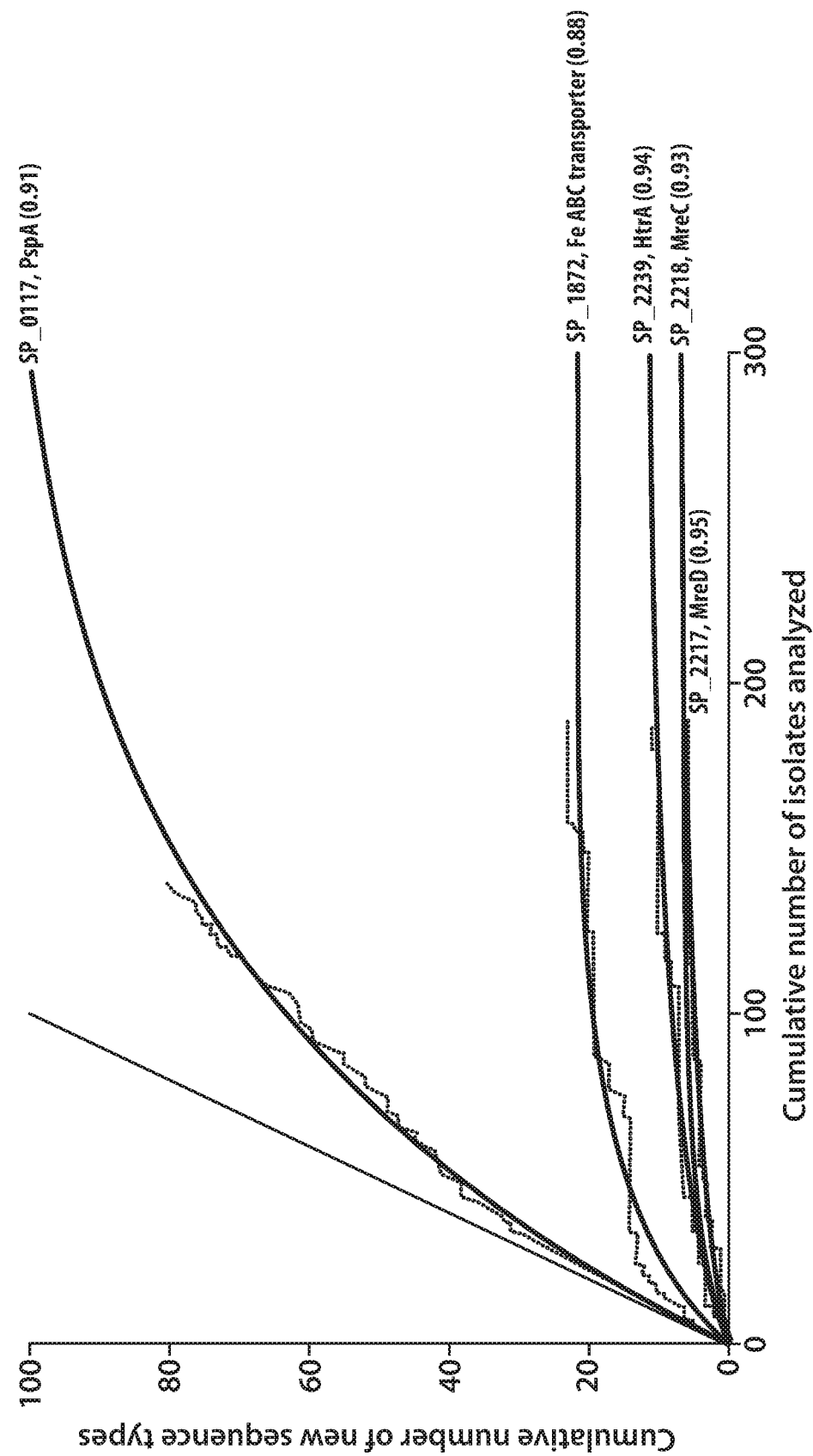

METHODS AND COMPOSITIONS USING HIGHLY CONSERVED PNEUMOCOCCAL SURFACE PROTEINS

CROSS-REFERENCE TO RELATED APPLICATIONS

This application claims the benefit of priority to U.S. Provisional Application No. 62/479,848, filed Mar. 31, 2017.

STATEMENT AS TO FEDERALLY SPONSORED RESEARCH

This invention was made with Government Support under Contract No. AI081687 awarded by the National Institutes of Health. The Government has certain rights in the invention.

FIELD OF THE INVENTION

This invention is generally in the field of infections by the bacterium *Streptococcus pneumoniae*. In particular, the invention provides methods and compositions that use one or more highly conserved genes encoding a surface protein of *Streptococcus pneumoniae* for diagnosing, treating, or preventing infection by *Streptococcus pneumoniae*. In particular embodiments, immunogenic compositions according to the invention include at least one in-common, highly conserved *Streptococcus pneumoniae* surface antigen or immunogenic fragment thereof, which may be used to elicit an immune response against a majority (i.e., >50%), advantageously a supermajority (i.e., at least 80%), and ideally all or nearly all (e.g., 90 or more) of the known capsular serotypes of *Streptococcus pneumoniae*, thus advancing modes of addressing *Streptococcus pneumoniae* infection toward a universal vaccine.

BACKGROUND OF THE INVENTION

Pneumonia is an ailment that can be lethal, particularly to the elderly and young. Every year, approximately 1.3 million children under the age of five die from pneumonia, mostly in the developing world. Infection by the bacterium, *Streptococcus pneumoniae* (also referred herein as "pneumococcus"), the most common cause of severe pneumonia, kills more than half a million children annually. While even healthy adults may be infected by *S. pneumoniae*, the elderly, immunocompromised individuals, and children are at greatest risk from the disease. Pneumococcus can also cause bacterial sepsis, bacterial sinusitis, and bacterial meningitis, and is the leading cause of middle ear infection (otitis media).

*S. pneumoniae* strains vary by region, and there are more than 94 capsular serotypes. While there has been some success in making pneumococcal vaccines, current pneumococcal vaccines do not protect against most pneumococcal capsular serotypes. For example, one currently marketed vaccine, PREVNAR-13® (Wyeth LLC, marketed by Pfizer, New York, N.Y.), is only partially efficacious, protecting against only 13 of the 94 or so pneumococcal capsular serotypes. Another marketed vaccine, PNEUMOVAX®-23 (Merck, Kenilworth, N.J.), offers no protection for children less than two years old, and no protection for older children and adults against 71 of the 94 or so pneumococcal capsular serotypes.

Accordingly, there has been an acute desire to find a "common protein" or "universal" vaccine that would be useful for immunizing against all or nearly all pneumococcal strains (currently ~94 known), a supermajority, e.g., at least 80%, or at least a majority, e.g., greater than 50%, of the known pneumococcal strains. A critical barrier to the development of such a "common protein" vaccine has been pneumococcal antigenic diversity driven by host immunological selective pressure. The paradigm for development of a common protein vaccine has primarily been empirical, top-down, trial and error testing of known antigenic outer surface protein candidates. Such an approach has yielded poor results primarily because promiscuously recombinant bacteria like *S. pneumoniae* are adept at "immune escape", based on the fact that the immunologically active regions of nearly all major surface proteins that have been examined mutate constantly. Copies of a mutated gene that provides an *S. pneumoniae* cell with a selective advantage for evading attack by an immune response will be rapidly transferred from the mutant cell to recipient cells owing to a promiscuous horizontal (lateral) gene transfer system with subsequent recombination of the mutated gene (recombinational mutation) into the genomes of the recipient cells.

Clearly, needs remain for compositions and methods for identifying, treating, or preventing infections by *S. pneumoniae* that are more resistant to the adaptive ability of *S. pneumoniae* cells to evade an immune response.

SUMMARY OF THE INVENTION

The present invention provides a particularized family of streptococcal surface antigens that are useful as immunogens to elicit an immune response recognizing all or nearly all *S. pneumoniae* strains. Polypeptide immunogens of the present invention therefore represent a very important advance in the search for a universal pneumonia vaccine. The immunogenic polypeptides of the present invention are serotype-independent and are characterized by their presence across virtually all genomic variants of *S. pneumoniae* and by their very low incidence of sequence variability from one allele to another across *S. pneumoniae* populations.

The candidate immunogens of the invention are referred to herein as cold spot polypeptides, which makes reference to the fact that the encoding genes for the polypeptides are located in recombinationally quiescent regions of the *S. pneumoniae* genome flanking the rRNA operons and show very low rates of mutation. Genes from such recombinationally quiescent loci are termed "cold spot genes", and their expression products are referred to herein as "cold spot polypeptides".

In a particular embodiment, the present invention provides an immunogenic composition comprising:
 (a) at least one cold spot polypeptide or an immunogenic fragment thereof, which polypeptide comprises at least a portion of an extracellular domain of a *S. pneumoniae* surface protein, wherein said protein:
  (i) is in-common to all or nearly all known strains of *S. pneumoniae*, and
  (ii) has at least a 98% average amino acid sequence pairwise homology among such known strains of *S. pneumoniae*;
 (b) a pharmaceutically acceptable vehicle or excipient; and
 (c) optionally, an adjuvant.

Preferred polypeptides disclosed herein have an average amino acid sequence pairwise homology of at least 99%.

Most preferred polypeptides of the present invention have an average amino acid sequence pairwise homology of at least 99.5%.

In particular embodiments, immunogenic cold spot polypeptides may be selected from the surface antigens set forth in Tables 1A and 1B, infra, having SEQ ID NOs:1-273. Of particular interest are extracellular regions of such cold spot polypeptides, as those regions correspond to naturally occurring surface targets on pneumococcal cells. Particular extracellular domains derived from the top six of 21 selected cold spot polypeptides from Table 1A are set forth in Table 3, infra, having SEQ ID NOs:336-341. Natural allelic variants of such polypeptides and extracellular portions thereof are equally useful immunogens for the compositions and uses disclosed herein.

The invention also provides methods of making immunogenic compositions comprising one or more cold spot polypeptides described herein for use in raising an immune response against a majority (i.e., >50%), more preferably a supermajority (i.e., at least 80%), and even more preferably all or nearly all (e.g., 90 or more) of the known serotypes of Streptococcus pneumoniae.

In a particular embodiment, the invention provides a method of making an immunogenic composition for raising an immune response producing antibodies reactive against at least 80 different serotypes of S. pneumoniae, said method comprising:

(1) selecting one or more cold spot surface antigens of S. pneumoniae, (2) isolating one or more polypeptide segments from an extracellular domain of the one or more cold spot surface antigens selected in (1), and, (3) formulating said one or more isolated polypeptide segments obtained in (2) by admixing said isolated polypeptide segments with a pharmaceutically acceptable carrier, to produce an immunogenic composition for inoculating human subjects against S. pneumonia infection.

In the above method of making an immunogenic composition according to the invention, the immunogenic composition may also include one or more adjuvants.

In another embodiment, in the method of making an immunogenic composition as described above, the immunogenic composition is effective for raising an immune response producing antibodies reactive with at least 90 S. pneumonia serotypes. More preferably, the immunogenic composition in the above method of making an immunogenic composition of the invention is effective for raising an immune response producing antibodies reactive with at least 91 S. pneumonia serotypes. Even more preferably, the immunogenic composition in the above method of making an immunogenic composition of the invention is effective for raising an immune response producing antibodies reactive with at least 93 S. pneumonia serotypes.

In another embodiment, step (1) of the above method of making an immunogenic composition according to the invention selects 1, 2, 3, 4, or 5 cold spot surface antigens. In another embodiment, step (1) of the above method of making an immunogenic composition according to the invention selects 1 or 2 cold spot surface antigens. In a further embodiment, step (1) of the above method of making an immunogenic composition according to the invention selects 1 cold spot surface antigen from a strain of S. pneumonia.

The present invention also relates to a method of eliciting an immune response in a mammal, such as a human, said method comprising administering to said mammal an immunogenic composition comprising:

(a) at least one cold spot polypeptide or an immunogenic fragment thereof, which polypeptide comprises at least a portion of an extracellular domain of a S. pneumoniae surface protein, wherein said protein:
   (i) is in-common to all or nearly all known strains of S. pneumoniae, and
   (ii) has at least a 98% average amino acid sequence pairwise homology among such known strains of S. pneumoniae;
(b) a pharmaceutically acceptable vehicle or excipient; and
(c) optionally, an adjuvant.

In other embodiments, such a method of eliciting an immune response will utilize two or more such immunogenic compositions.

Also contemplated herein is a method of vaccinating a subject against S. pneumoniae infection, said method comprising administering at least one immunogenic composition according to the invention to a subject in an amount or for a number of administrations sufficient to elicit an immune response characterized by the presence of antibodies recognizing a majority of S. pneumoniae serotypes. Currently, there are 94 known serotypes of S. pneumoniae, with additional serotypes expected to evolve or to become recognized in the future. Accordingly, for the purposes of the present invention, "a majority of S. pneumoniae serotypes" will signify 50 or more serotypes. Recognizing that commercial pneumonia vaccines (e.g., PREVNAR®, PNEU-MOVAX®) available today address only up to 23 of the known serotypes, a vaccine composition capable of addressing a majority of S. pneumoniae serotypes represents a significant advance in the field of vaccine development.

BRIEF DESCRIPTION OF THE DRAWINGS

FIG. 1 shows the estimation of the number of S. pneumoniae isolates necessary to analyze in order to be representative of species diversity. Two hundred thirty-one (231) fully sequenced S. pneumoniae genomes were analyzed and allelic variants compared for four cold spot proteins, MreD (SP_2217), MreC (SP_2218), HtrA (SP_2239) and an Fe ABC transporter (SP_1872), and for a more variable surface antigen, PspA (SP_0117). For each isolate (x axis), they value increases by 1 if the isolate represents an allelic variant not previously identified in the genome set. The resulting plots are depicted in dotted lines, with fitted non-linear regression curves. The corresponding goodness of fit is shown in parentheses. The model used for the non-linear regression is the one-phase exponential association function $y=y_{max}(1-e^{-Kx})$. As the data set increases and becomes more representative of species diversity, fewer new alleles appear, and the tangent to the regression curve tends toward a slope of 0, at which point one can estimate both the number of allelic variants likely to appear and the approximate number of isolates required in order to achieve this maximal representation of the diversity of the species. It is seen that for proteins as allelically invariant as cold spot proteins, the number of isolates necessary to analyze to be representative of S. pneumoniae diversity is between 100 and 200 isolates.

DETAILED DESCRIPTION OF THE INVENTION

This invention is based on the discovery of a family of S. pneumoniae genes that are highly conserved in identical or highly homologous forms throughout all or nearly all known S. pneumoniae strains. The genes of this family are examples of recombinational "cold spots" in the genome where very low levels of sequence variability are observed across the known *S. pneumoniae* strains. Owing to an exceptionally promiscuous system of horizontal DNA exchange across *S. pneumonia* cells, recombinational mutation frequently alters or deletes genes along approximately 74 percent of the *S. pneumoniae* (pneumococcal) genome. See, Croucher et al., *Science*, 331: 430-434 (2011). The approach taken for this invention was to identify pneumococcal genes that are specifically localized in recombinational "cold spot" regions of the pneumococcal genome, where mutation frequency is very low. Genes isolated from within such recombinationally quiescent regions are referred to herein as "cold spot" genes, and the polypeptides encoded by such "cold spot" genes are referred to as "cold spot polypeptides". A "cold spot" gene is characterized by a lack of high sequence variability among its known alleles across all or nearly all strains of *S. pneumoniae*. Such a lack of variability in nucleotide sequence of a given cold spot gene from strain to strain is in turn reflected in a low variability in the amino acid sequence of the encoded cold spot polypeptide as expressed in all or nearly all strains of *S. pneumoniae*. Typically, and preferably, a cold spot polypeptide described herein has a greater than 98% average amino acid pairwise homology from strain to strain of *S. pneumoniae* (i.e., there is greater than 98% average amino acid pairwise homology between allelic forms of the cold spot polypeptide from strain to strain); in most cases, and more preferably, a cold spot polypeptide described has greater than 99% average amino acid pairwise homology from strain to strain of *S. pneumoniae*, and, in many cases, and even more preferably, a cold spot polypeptide described has a greater than 99.5% average amino acid pairwise homology from strain to strain of *S. pneumoniae*. In the most preferred embodiments, sixteen cold spot polypeptides are disclosed having a percent average amino acid pairwise homology from strain to strain of *S. pneumoniae* of 99.50% or higher. Such significantly low levels of variability in cold spot gene (nucleotide) sequences and in cold spot polypeptide (amino acid) sequences from strain to strain reflect the presence of an innate and extremely high selective pressure to maintain the existing "cold spot" gene sequences and their encoded polypeptide sequences across all or nearly all known pneumococcal strains and serotypes.

While not intending to be bound by any particular theory or mechanism, it is more likely that the resistance to sequence variability in the cold spot genes suggests that most recombinational events leading to mutations have lethal consequences either directly or by impacting adjacent genetic loci (e.g., rrn operons) that are essential for growth.

All of the cold spot genes disclosed herein encode polypeptides that are expressed on the surface of a majority or, indeed, of all or nearly all, e.g., >90%, of *S. pneumoniae* capsular serotypes. Cold spot polypeptides of the present invention will be expressed on the surface of at least 50, preferably at least 80, more preferably at least 90, and most preferably all of the 94 capsular serotypes currently known. Reflecting the high nucleotide sequence conservation of the cold spot genes, the corresponding amino acid sequences of the encoded *S. pneumoniae* cold spot polypeptides are also highly conserved across the known *S. pneumoniae* strains. Accordingly, cold spot polypeptides, extracellular domains of cold spot polypeptides, or immunogenic fragments of the cold spot extracellular domain, are particularly useful in immunogenic and vaccine compositions to elicit production of antibodies that will bind the polypeptides or their antigenic fragments that are expressed on the surface of all or nearly all *S. pneumoniae* strains. The isolated extracellular domain of a cold spot polypeptide is also referred to as the "cold spot extracellular domain". Accordingly, a cold spot polypeptide, an isolated cold spot extracellular domain, or an immunogenic fragment comprising all or a portion the extracellular domain thereof, may be used as the basis of a "universal" or "capsular serotype-independent" vaccine that can elicit antibody that binds all or nearly all *S. pneumoniae* cells, independent of any *S. pneumoniae* cell's known or unknown capsular serotype classification. For the purposes of the present invention, a *S. pneumoniae* surface antigen polypeptide will be considered "capsular serotype-independent" if it is a portion of a surface protein common to all or nearly all serotypes of *S. pneumoniae*. Preferred such polypeptides will have an amino acid sequence variability from strain to strain that is so low that it exhibits an average amino acid pairwise homology among known serotypes of *S. pneumoniae* of greater than 98%, preferably greater than 99%, and most preferably greater than 99.5%. Immunization with such an in-common, highly conserved cold spot polypeptide according to the invention elicits production of antibodies capable of recognizing a supermajority, e.g., greater than 90% of known *S. pneumoniae* strains.

In order that the invention may be more fully understood, the following terms are defined.

Unless indicated otherwise, when the terms "about" and "approximately" are used in combination with an amount, number, or value, then that combination describes the recited amount, number, or value alone as well as the amount, number, or value plus or minus 10% of that amount, number, or value. By way of non-limiting example, the phrases "about 40%" and "approximately 40%" disclose both "40%" and "from 36% to 44%, inclusive".

The terms "protein" and "polypeptide" are used interchangeably to refer to a polymer of amino acid residues connected by peptide bonding as used and understood in the fields of protein biochemistry and molecular biology. Typically, but not exclusively, the terms "protein" and "polypeptide" are used to refer to polymers of 20 or more amino acid residues linked by peptide bonds. The term "peptide", like "protein" and "polypeptide", also refers to a polymer of two or more amino acid residues linked by peptide bonding, but usually, although not exclusively, is used to describe a polymer of less than 20 amino acid residues.

The terms "antigenic determinant" and "epitope" are used synonymously and refer to the specific site on an antigen at which an antibody molecule binds. The antigenic determinant or epitope of an antigen is complementary to the antigen binding site of an antibody. An antigen may have only one or, as is usually the case, several or even many epitopes. Epitopes of a given antigen may be present as multiple copies of structurally identical moieties, as in the case of repetitive amino acid sequences in some proteins, or distinctly different, in which case each epitope could be bound by a different antibody. An epitope may be composed of a sequence of contiguous amino acid residues (linear epitope) along a polypeptide chain or non-sequential (non-linear) amino acid residues from segments of a polypeptide chain (or even more than one polypeptide chain) that are brought together in a folded, three-dimensional conformation. A minimal sequential (linear) epitope of a polypeptide is typically five to eight amino acid residues in length (see, e.g., Kuby, *Immunology*, $2^{nd}$ ed., (W.H. Freeman and Company, New York, 1994), sentence bridging pp. 94-95; Watson et al., In *Molecular Biology of the Gene, Fourth Edition* (The Benjamin/Cummings Publishing Co., Inc., 1987), p. 836; Davis et al., In *Microbiology, Second Edition* (Harper & Row, Hagerstown, 1973). Epitopes of a polypeptide may be at least 5, 6, 7, 8, 9, 10, 11, 12, 13, 14, 15, 16, 17, 18, 19, or 20 contiguous amino acid residues. Epitopes of particular interest for the purposes of this invention are those located in the extracellular domain of a cold spot polypeptide, as such epitopes are expected to be exposed on the surface of S. pneumoniae cells and thus available for binding by an antibody.

The term "antigen", as used herein, refers to any compound that is bound by an antibody, or antigen-binding fragment of the antibody, wherein the antibody was produced by an immune response elicited by an immunogenic composition comprising an epitope (antigenic determinant), which is contacted by the antigen binding site of the elicited antibody and which is also present on the antigen. The degree of specificity and affinity of an antibody to bind a cognate epitope of an intended (target) antigen is determined by the structural configuration and complementary determining regions (CDRs) of the antigen binding site of the elicited antibody that provides both spatial and non-covalent bonding features that are necessary to bind and retain the cognate epitope in the antigen-binding site, and thereby form an antibody-target antigen complex to the exclusion of other molecules that lack the structural features of the cognate epitope under the same environmental conditions. It is understood that some molecules may contain cross-reacting epitopes that approximate the features of the cognate epitope of the target antigen so that such molecules may also be bound by the antibody that was raised against the cognate epitope of the target antigen. Typically, however, antibody binding to a cross-reacting epitope is with a lower affinity as compared to the target antigen (or fragment thereof) containing the cognate epitope. Typically such cross-reactivity will be seen between only highly homologous antigens; of significance here is that BLAST comparison of the cold spot gene products described herein against all protein sequences in the NCBI GenBank databases found no homology other than to conserved proteins of other streptococcal strains.

The binding affinity of an antibody to a target antigen, or antigenic fragment thereof, comprising the cognate epitope can be readily determined using any of a number of methods available in the art including, but not limited to, enzyme linked immunosorbent assay (ELISA), surface plasmon resonance-based measurements (for example, using a Biacore® surface plasmon resonance instrument, Biacore® AB, Uppsala, Sweden), immuno-dot blot assay, Western (immuno) blotting, immuno-affinity chromatography, immuno-precipitation, flow cytometry, and fluorescence-activated cell sorting (FACS). More preferably, a method for determining affinity of an antibody to a target antigen, or antigenic fragment thereof, is determined using enzyme linked immunosorbent assay (ELISA), surface plasmon resonance-based measurements, flow cytometry, or FACS.

Preferred antigens of the invention include cold spot polypeptides encoded by cold spot genes, isolated cold spot extracellular domains of a cold spot polypeptide (cold spot extracellular domains), and immunogenic fragments of a cold spot extracellular domain. Preferred antibodies, or antigen-binding fragments thereof, bind to an epitope of the cold spot extracellular domain that is expressed on the surface of S. pneumoniae cells.

Unless indicated otherwise, the term "immunogen", as used herein, refers to any compound or composition that elicits an immune response in a human or non-human subject that has been inoculated with the compound or composition, wherein the immune response includes production of antibody that binds the compound or a component of the composition. Such compounds and compositions are also described as "immunogenic".

The term "immunogenic fragment" as used herein, with respect to a cold spot polypeptide, refers to a fragment of a cold spot polypeptide that is capable of eliciting an immune response when a mammalian subject is inoculated with the polypeptide, wherein the elicited immune response includes production of antibodies recognizing the cold spot polypeptide or an antigenic fragment of the cold spot polypeptide.

As used herein, the terms "recombinational cold spot" or simply "cold spot" refer to a gene in the genome of S. pneumoniae that is characterized by the absence of alleles or by a low incidence of sequence variability among known alleles of the gene across the 94 known serotypes of S. pneumoniae or the terms refer to the encoded polypeptide of such a gene. The low incidence of sequence variability means that the known alleles of a cold spot gene encode cold spot polypeptides that exhibit greater than 98% average pairwise amino acid sequence homology. In most cases, the allelic sequences of a cold spot gene useful in the invention encode polypeptides that show greater than 99% average pairwise amino acid sequence homology, and in many cases more than 99.5% average pairwise amino acid sequence homology across any particular population of pneumococcal isolate strains considered. Thus, the amino acid sequence of a polypeptide (or protein or peptide) encoded by a cold spot gene may be referred to as a cold spot amino acid sequence, and the encoded polypeptide may be referred to as a "cold spot polypeptide". A preferred "cold spot polypeptide" useful in the invention is (1) encoded by a cold spot gene of S. pneumoniae, (2) is a polypeptide expressed on the surface of S. pneumoniae cells, (3) is in-common across all or nearly all strains of S. pneumoniae, meaning that the surface polypeptide or an allelic variant thereof is encoded in all or nearly all of the known S. pneumoniae genomes, (4) has an amino acid sequence showing greater than 98% average amino acid sequence pairwise homology across such known S. pneumoniae strains, and (5) is immunogenic, that is, capable of eliciting an immune response when administered to a mammal such as a human. Preferably, cold spot polypeptides according to the invention are suitably immunogenic so as to raise an antibody response that is reactive with whole S. pneumoniae cells (i.e., the cold spot protein is an immunogenic S. pneumoniae cell surface antigen). It will be understood from the context of a description herein whether the term "cold spot polypeptide" refers generally to the full-length surface antigen polypeptide encoded by a cold spot gene of a S. pneumoniae or to a portion thereof comprising the cold spot extracellular domain that is expressed on the surface of S. pneumoniae cells. The isolated extracellular domain(s) of a cold spot polypeptide may also be referred to as the "cold spot extracellular domain(s)". Smaller portions of the extracellular domain are also contemplated, such as portions corresponding to the fragment encoded on a convenient restriction fragment found in the coding sequence, so long as the portions are still immunogenic.

As used herein, the term "all or nearly all S. pneumoniae strains" or "all or nearly all strains" means, with respect to a cold spot polypeptide as described herein, that the gene encoding the peptide is present in at least 95% of genomes in any collection of at least 123 Streptococcus pneumoniae strains. The cold spot gene products described in Table 1A (or alleles) were found to be in-common or universally present in all of the 231 Streptococcus pneumoniae full genomes available for analysis at the time the present discoveries were made. Most of the additional genes located in the recombinationally quiescent flanking regions adjacent the rrn operons of *S. pneumoniae* cited in Table 2 are present in at least 95% of the 123 or more genomic sequences studied to compile that listing. Additional genomes continue to be made available, but the inventor's non-linear regression analysis of cold spot proteins in relation to number of different strains revealed that analysis of at least 150 or so different strains would be accurately representative of the diversity of a particular genetic sequence over the population of genomes compared. Accordingly, for the purposes of the present invention, a gene or gene expression product found to be present in at least 95%, especially 98%, 99%, 99.5%, or up to 100% of strains in any population of at least 123 different *Streptococcus pneumoniae* strains will be considered universally present, or "in-common", across the population, or present in "all or nearly all known strains" of *Streptococcus pneumoniae*. The term "all or nearly all known serotypes" as used in regard of different serotypes of *Streptococcus pneumoniae*, means at least 80 of the currently known *Streptococcus pneumoniae* serotypes. At the time of the present invention, 94 or so *Streptococcus pneumoniae* serotypes are known, but additional serotypes may be characterized and published in the future. To provide protection against as many pneumococcal serotypes as possible is a common desire of practitioners in the field of vaccines, and therefore, for the purposes of the present invention, in the context of eliciting immune responses, an immune response reactive with 80, 85, 90, 91, 92, 93, or 94 serotypes will be considered reactive with "all or nearly all known serotypes" of *Streptococcus pneumoniae*. In the same context, an immune response reactive with 50 or more serotypes will be considered reactive with "a majority of the known serotypes" of *Streptococcus pneumoniae*.

The terms "disorder" and "disease" are synonymous and refer to any pathological condition. Diseases of particular interest with respect to this invention are those caused by *S. pneumoniae* infection of particular tissues, organs or systems, such as pneumonia (lung infection), otitis media (middle ear infection), sinusitis (sinus infection), sepsis (bacteremia, bloodstream infection), and meningitis (infection of the meninges, which comprise three membranes covering the brain and spinal cord).

As used herein, the terms "treatment" and "treating" refer to any regimen that alleviates one or more symptoms or manifestations of a disease or disorder caused by *S. pneumoniae*, that inhibits progression of a disease or disorder caused by *S. pneumoniae*, that arrests progression or reverses progression (causes regression) of a disease or disorder caused by *S. pneumoniae*, or that prevents onset of a disease or disorder caused by *S. pneumoniae*. Treatment may include prophylaxis (preventative treatment) of one or more diseases caused by *S. pneumoniae* and includes but does not require cure of such a disease. Treatment may include active immunization resulting in an endogenous immune response that alleviates or combats *S. pneumoniae* infection or may include the use of exogenously prepared anti-cold spot polypeptide antibodies (for example, polyclonal antiserum or monoclonal antibodies) in passive immunization (immune therapy).

The terms "immunogen" and "immunogenic" refer to any compound or substance that is capable of eliciting an immune response in a human or non-human individual to the compound or substance.

A "vaccine composition," or simply "vaccine," has the definition commonly understood in the art and refers to an immunogenic composition, which upon administration to a human or non-human individual, elicits an initial (primary) immune response that produces antibodies that bind to an antigenic compound or substance in the vaccine composition, and wherein a secondary immune response is elicited later when the individual is again exposed to a source of the compound or substance. For example, a vaccine designed to provide an individual with a protective immune response ("protective immunity", see below) against an infectious agent, such as a pathogenic virus or bacterium, may comprise inactivated or avirulent virus particles, killed bacterial cells, or one or more antigenic polypeptides, polysaccharides, or other components of the pathogenic virus or bacterium, such that a primary immune response elicited to the viral or bacterial components in the vaccine not only produces a first population of antibodies that bind to the viral or bacterial components of the vaccine but also produces memory immune cells that will trigger a secondary immune response against the corresponding virus or bacterium that infects the individual at a later time. Preferably, a secondary immune response is more pronounced than the primary response to the vaccine and is elicited every time the individual is subsequently exposed to an infecting virus or bacterium that expresses or presents the viral or bacterial component(s) present in the vaccine composition. To maintain the ability to elicit a robust secondary immune response, an individual may be administered the vaccine again at a later time as a "boost" (or "booster shot") that stimulates production of additional memory immune cells in the individual. For example, a commonly known vaccine that is periodically followed by one or more boosts (booster shoots) to maintain the ability of an individual to elicit a robust secondary immune response, is any of the tetanus vaccines currently in use to provide protection from infection by the bacterium *Clostridium tetani*.

The term "isolated" when used to describe the various nucleic acid and polypeptide molecules disclosed herein, means a nucleic acid or polypeptide that has been identified and separated and/or recovered from the nucleic acid or polypeptide's natural environment. Contaminant components of the natural environment are materials that would typically interfere with a diagnostic, therapeutic, or prophylactic use of a nucleic acid or polypeptide, and may include enzymes, hormones, carbohydrates, lipids, and other proteinaceous or non-proteinaceous molecules. An isolated polypeptide may include a polypeptide in situ within recombinant cells engineered to express it, since at least one component of the polypeptide's natural environment will not be present. Ordinarily, however, an isolated polypeptide will be prepared by at least one purification step. An "isolated nucleic acid", "isolated polynucleotide", or an "isolated polypeptide-encoding nucleic acid" is a nucleic acid molecule that is identified and separated from at least one contaminant nucleic acid molecule with which it is ordinarily associated in a natural source of such nucleic acid, e.g., the *Streptococcus pneumoniae* genome. An isolated nucleic acid (or isolated polynucleotide or isolated polypeptide-encoding nucleic acid) is other than in the form or setting in which it is found in nature. An isolated nucleic acid (or isolated polynucleotide or isolated polypeptide-encoding nucleic acid) therefore is distinguished from the specific polypeptide-encoding nucleic acid molecule as it exists in natural cells. An isolated nucleic acid (or isolated polynucleotide) includes polypeptide-encoding nucleic acid molecules contained in cells that ordinarily express the polypeptide but where, for example, the nucleic acid molecule is in a different location (e.g., a plasmid) from that of natural cells (e.g., the bacterial chromosome).

The term "isolated" or "isolate" when used to describe a cell means that the cell and its genetically uniform sister cells produced by cell division have been taken out of or separated from an environment comprising at least one other, genetically diverse cell, which may be a prokaryotic or eukaryotic cell. For example, cells of a *Streptococcus pneumoniae* capsular serotype are typically maintained in stock cultures that are generated by single colony purification on an agar plate, wherein a single colony is assumed to contain genetically uniform sister cells of the particular serotype. An "isolate" of *S. pneumoniae* may also refer to a cell and its genetically uniform sister cells that were purified as a single colony from a human, clinical sample (such as from sputum, bronchial lavage, blood, tissue, organic material) and that have been maintained and passed on as a stock culture.

The term "polynucleotide" as referred to herein means a polymeric form of two or more nucleotides, either ribonucleotides (RNA) or deoxyribonucleotides (DNA), or a modified form of either type of nucleotide. The term includes single and double stranded forms of RNA and DNA, but preferably is double-stranded DNA.

The term "isolated polynucleotide" as used herein shall mean a polynucleotide (e.g., of genomic, cDNA, or synthetic origin, or some combination thereof) that is not associated with all or a portion of a polynucleotide with which the "isolated polynucleotide" is found in nature or is operably linked to a polynucleotide that it is not linked to in nature.

The term "vector", as used herein, is intended to refer to a nucleic acid molecule capable of transporting another nucleic acid to which it has been linked. One type of vector is a plasmid, which refers to a circular double stranded DNA molecule into which additional DNA segments may be inserted. Another type of vector is a viral vector wherein additional DNA segments may be inserted into the viral genome. Of particular interest are bacteriophage vectors, used to transduce bacterial host cells. Certain vectors are capable of autonomous replication in a host cell into which they are introduced (e.g., bacterial vectors having a bacterial origin of replication and episomal mammalian vectors). Other vectors (e.g., non-episomal mammalian vectors) can be integrated into the genome of a host cell upon introduction into the host cell, and thereby are replicated along with the host genome. Moreover, certain vectors are capable of directing the expression of genes to which they are operatively linked. Such vectors are referred to herein as "recombinant expression vectors" or simply, "expression vectors". In general, expression vectors of utility in recombinant DNA techniques are often in the form of plasmids. In the present specification, "plasmid" and "vector" may be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The term "operably linked" refers to a juxtaposition wherein the components described are in a relationship permitting them to function in their intended manner. A nucleic acid control sequence "operably linked" to a nucleic acid coding sequence is ligated in such a way that expression of the coding sequence is achieved under conditions compatible with the control sequence. "Operably linked" sequences include both expression control sequences that are contiguous with a gene of interest and expression control sequences that act in trans or at a distance to control the gene of interest. The term "expression control sequence" as used herein refers to polynucleotide sequences that are necessary to effect the expression of coding sequences to which they are ligated. For prokaryotic or eukaryotic host cells, expression control sequences will include appropriate transcription initiation, termination, and promoter sequences. If eukaryotic hosts are employed, other control elements that may be used include enhancer sequences; efficient RNA processing signals, such as splicing and polyadenylation signals; sequences that stabilize cytoplasmic mRNA; sequences that enhance translation efficiency (such as, a Kozak sequence); sequences that enhance protein stability; and, when desired, sequences that enhance protein insertion into or translocation across one or more cell membranes. The term "control sequence" is intended to include components whose presence is essential for gene transcription and translation and processing of expressed gene product, and can also include additional components whose presence is advantageous, for example, leader sequences and fusion partner sequences.

The term "recombinant host cell" or simply "host cell", as used herein, is intended to refer to a cell into which exogenous nucleic acid has been or can be introduced. It will be understood that such terms are intended to refer not only to the particular subject cell, but also to the progeny of such a cell. Host cells include prokaryotic and eukaryotic cells. Suitable prokaryotic host cells useful in the invention include, but are not limited to, *Escherichia coli*, *Bacillus* (for example, *B. subtilis*), *Streptomyces* (for example, *S. lividans*), *Salmonella*, and *Pseudomonas*. Eukaryotic cells that may be used as host cells in the present invention include protist cells, fungal cells, insect cells, plant cells, and animal cells. Preferably, an animal host cell is a mammalian cell of an established cell line, such as, but not limited to, CHO, HEK 293, COS, NS0, and SP2 cell lines. A preferred CHO cell carries a dhfr− mutation (as described in Urlaub and Chasin, *Proc. Natl. Acad. Sci. USA*, 77: 4216-4220 (1980)) and is used with a DHFR selectable marker (such as described in Kaufman and Sharp, *J. Mol. Biol.*, 159: 601-621 (1982)). A preferred insect host cell is a cell of the Sf9 cell line. Preferred fungal host cells are yeast cells, such as *Saccharomyces* (for example, *S. cerevisiae*), *Kluveromyces* (for example, *K. lactis*), *Schizosaccharomyces* (for example, *S. pombe*), and *Picha* (for example, *P. pastoris*). A particularly preferred yeast host cell is *Saccharomyces cerevisiae*. The preferred host for prokaryotic expression of polypeptides according to this invention is *E. coli*. The use of a *Streptococcus* (for example, *S. pneumoniae*) strain as a host is possible but not preferred, as it would require separation of the recombinantly expressed cold spot polypeptide from other streptococcal proteins.

The term "physiologically acceptable" as used in reference to a compound or composition means that the compound or composition is compatible with the physiology of a living subject, e.g., a human or a non-human animal, to which the compound or composition is to be administered and also is not deleterious to the cold spot polypeptide, or antigenic fragment thereof, or to a desired property or activity of any other component that may be present in a composition. Any compound or composition used in standard methods to raise polyclonal or monoclonal antibodies is also understood to be sterile and used under sterile conditions to avoid introduction of infectious, undesirable, and/or interfering substances into the subject and/or cells thereof. A physiologically acceptable compound or composition used in producing polyclonal or monoclonal antibodies must of course be compatible with the established protocols. Nevertheless, vehicles (carriers), compounds, and compositions that are acceptable in protocols for raising polyclonal or monoclonal antibodies in non-human animals are not necessarily approved and "pharmaceutically acceptable" for use in humans. "Pharmaceutically acceptable" refers to that which is not only physiologically acceptable but also of the quality and type that is permissible for medical use in treating humans.

A composition or method described herein as "comprising" one or more named elements or steps is open-ended, meaning that the named elements or steps are essential, but other elements or steps may be added within the scope of the composition or method. To avoid prolixity, it is also understood that any composition or method described herein as "comprising" (or "which comprises") one or more named elements or steps also describes the corresponding, more limited, composition or method "consisting essentially of" (or "which consists essentially of") the same named elements or steps, meaning that the composition or method includes the named essential elements or steps and may also include additional elements or steps that do not materially affect the basic and novel characteristic(s) of the composition or method. It is also understood that any composition or method described herein as "comprising" or "consisting essentially of" one or more named elements or steps also describes the corresponding, more limited, and close-ended composition or method "consisting of" (or "which consists of") the named elements or steps to the exclusion of any other unnamed element or step. In any composition or method disclosed herein, known or disclosed equivalents of any named essential element or step may be substituted for that element or step.

Other terms are defined in the text below or, unless indicated otherwise, the meaning of other terms used herein is the same as understood and used by persons in the corresponding field, including, but not limited to, the fields of microbiology, population and evolutionary biology, immunology, genetics, biochemistry, molecular biology, and medicine.

A Family of Cold Spot Genes of *S. Pneumoniae*

The approach taken for this invention was to identify pneumococcal genes (encoding polypeptides) that reside in a portion of the *S. pneumoniae* genome having very low mutational frequency. In the present case, the regions flanking (e.g., roughly 50 kb upstream and 50 kb downstream of) ribosomal RNA (rRNA) operons of the *Streptococcus pneumoniae* genome were analyzed. The pneumococcal genome contains four copies of the essential rRNA operons (rrn operons). See, Tettelin et al., *Science*, 293: 498-506 (2001). It was proposed that genes located in these flanking regions would not exhibit high recombinational mutation frequency, i.e., the "cold spot" or recombinationally quiescent regions of the genome would prove to be highly resistant to incorporation and perpetuation of horizontally exchanged DNA (see, for example, the rationale of Bouchet et al., *Clin. Microbiol. Rev.*, 21(2): 262-273 (2008) in studies of multiple microbial species). Recombination of any of the rrn operons is nearly always a fatal event, and therefore strains evolving mutations or deletions in proximity to the rrn operons do not survive to propagate the genomic changes. Cold spot regions perpetuate genetic conservation because recombination-based mutation nearly always proves lethal, thus purging the vast majority of such recombinational mutants from the bacterial population.

According to the invention, cell surface-exposed cold spot polypeptides encoded by cold spot genes from such recombinationally quiescent regions are highly if not universally conserved across pneumococcal strains. According to the invention, surface antigens encoded by cold spot genes are likely to be particularly well-suited as universal or at least capsular serotype-independent protective antigens common to a majority up to all capsular serotypes of *S. pneumoniae*. Immunogenic compositions comprising such cold spot polypeptides or fragments thereof comprising all or a portion of the cold spot extracellular domain expressed on the surface of *S. pneumoniae* cells are useful for eliciting production of antibodies that bind to all or nearly all *S. pneumoniae* strains. Preferably, such elicited antibodies bind to 90 percent or more of all capsular serotypes. There are about 94 known *S. pneumoniae* capsular serotypes at the present time, and available capsular polysaccharide-oriented vaccines aim at eliciting an antibody response to a maximum of 23 different serotypes thus far. Because the immunogenic *S. pneumoniae* surface antigens of the present invention elicit antibodies recognizing less variant bacterial surface structures, it is possible to address many more of the capsular serotypes of *S. pneumoniae* in a single cold spot polypeptide-containing vaccine. Preferred immunogenic compositions according to the invention will raise antibodies recognizing 50 or more of the capsular serotypes, which represents a significant advance over available vaccines; moreover, since the present compositions comprise capsule-independent immunogens, it is contemplated that the elicited immune response to compositions of the invention will preferably recognize 80 or more, 85 or more, 90 or more, or 94 (e.g., all) capsular serotypes of *S. pneumoniae*. If additional serotypes are isolated, it is contemplated that immunogenic compositions of the present invention will elicit antibodies that recognize those new serotypes as well.

Three intensive, genome-scale, subcellular localization protein predictor programs were employed to analyze the approximately 50 kilobase pair region of each of the eight flanking regions of the four rrn operons in the *S. pneumoniae* genome: Gpos-mPloc, described by Shen et al., *Protein Pept. Lett.*, 16(12): 1478-1484 (2009); PSORTdb described by Yu et al., *Nucleic Acids Res.*, 39 (database issue): D241-D244 (2011); and LocateP described by Zhou et al., *BMC Bioinformatics*, 9:173 (2008). The analysis using these programs identified 104 genes located within the approximately 400 kilobase pairs that flank the four rrn operons present in the *S. pneumoniae* genome that putatively encode surface expressed polypeptides. These 104 genes represented ~5% of the roughly 400 kb of genomic sequences analyzed.

The 104 genes from the above analysis were further assessed (by study of the scientific literature pertaining to all 104 proteins and their cognates in other organisms) with respect to biological function of the encoded polypeptide to generate a family of 79 genes that are most likely to encode surface-expressed polypeptides that are vital (essential) to the survival of the cell. The 50 proteins were ranked by likelihood of being essential to cell survival, and the proteins deemed most vital for cell survival were further analyzed by amino acid sequence to identify numbers of alleles and the degree of amino acid homology across the library of 231 *S. pneumoniae* genomes that represented all known and fully sequenced strains contained in the NCBI GenBank database at the time. The predominant amino acid sequences for the 21 most vital cold spot polypeptides are given in Table 1A, below. In Table 1B, which follows Table 1A, information on the allelic variants of the predominant sequence for each of the 21 cold spot polypeptides is given, and the percent average amino acid sequence pairwise homology across the allelic variants is also given. The GBSP# is an internal laboratory designation for each of the proteins.

TABLE 1A

Polypeptides Encoded by Cold Spot Genes

| Polypeptide Designation/ Literature Acronym/ (length) | Protein Function | Amino Acid Sequence (SEQ ID NO:) |
|---|---|---|
| GBSP3 MreC (272 aa) | shape-determining protein | MNRFKKSKYV IIVFVTVLLV SALLATTYSS TIVTKLGDGI SLVDRVVQKP FQWFDSVKSD LAHLTRTYNE NESLKKQLYQ LEVKSNEVES LKTENEQLRQ LLDMKSKLQA TKTLAADVIM RSPVSWKQEL TLDAGRSKGA SENMLAIANG GLIGSVSKVE ENSTIVNLLT NTENADKISV KIQHGSTTIY GIIIGYDKEN DVLKISQLNS NSDISAGDKV TTGGLGNFNV ADIPVGEVVA TTHSTDYLTR EVTVKLSADT HNVDVIELVG NS (SEQ ID NO: 1) |
| GBSP14 PnpS (443 aa) | sensor histidine kinase | MKRYLQFWLV NLSVSLILIA GMALTWISKG IGLFLLALSL GLGGYWLFCL WKWEVAFETL HQPLLTSSEY FLEKGQEDLK SLAQYVSGLK TKVSQQDQQY KDLAETMEVL LSHLTMGTFL VSAQGQMLLS SRSLPHYFPD VDGDISSLDD LKRMDIRNLV HQAFDQKTRL KQEVSGFHEG DLILEVTAVP VFSPTQSVEA VLVLLYDLTT IRTYEKLNLA FVSNASHELR TPVTSIKGFA ETIKGMSAEE EALKDDFLDI IYKESLRLEH IVEHLLTLSK AQQMPIQWTT LSLAEFVQDL TQSLQPQLKK KDLQLKVQYP DDVTLVSDSQ LLSQILLNLL SNAIRYTEQG GKIEVKTQKV NEGIKISVSD TGIGISQLEQ DRIFERFYRV NKGRSRQTGG TGLGLAIVKE LSQLLGGQVT VTSQLGRGSC FTIFLPNQSF AQD (SEQ ID NO: 2) |
| GBSP15 unannotated protein of PulG superfamily (86 aa) | type II secretory pathway pseudopilin | MILLEAVVAL AIFASIATLL LGQIQKNRQE EAKILQKEEV LRVAKMALQT GQNQVSINGV EIQVFSSEKG LEVYHGSEQL LAIKEP (SEQ ID NO: 3) |
| GBSP22 CbiQ (264 aa) | ABC-type cobalt transport system permease component | MDSMILGRYI PGDSIVHRLD PRSKLLAMML LILIVFWANN PLTNLILFIA TGIFIALSGV SLSFFIQGLK SMFFLIAFTT IFQLFFISNG NVLFEFSFVR ITDYALQQAG IIFCRFVLII FFSTLLTLTT MPLSLASAVE ALLAPLKRVK VPVHEIGLML SMSLRFVPTL MDDTTRIMNA QKARGVDFGE GSIVQKVKAM IPILIPLFAT SLKRADSLAI AMEARGYQGG KGRSQYRQLK WTLKDTLTIL VILVLGCCLF FLKS (SEQ ID NO: 4) |
| GBSP23 HtrA (393 aa) | serine protease | MKHLKTFYKK WFQLLVVIVI SFFSGALGSF SITQLTQKSS VNNSNNNSTI TQTAYKNENS TTQAVNKVKD AVVSVITYSA NRQNSVFGND DTDTDSQRIS SEGSGVIYKK NDKEAYIVTN NHVINGASKV DIRLSDGTKV PGEIVGADTF SDIAVVKISS EKVTTVAEFG DSSKLTVGET AIAIGSPLGS EYANTVTQGI VSSLNRNVSL KSEDGQAIST KAIQTDTAIN PGNSGGPLIN IQGQVIGITS SKIATNGGTS VEGLGFAIPA NDAINIIEQL EKNGKVTRPA LGIQMVNLSN VSTSDIRRLN IPSNVTSGVV VRSVQSNMPA NGHLEKYDVI TKVDDKEIAS STDLQSALYN HSIGDTIKIT YYRNGKEETT SIKLNKSSGD LES (SEQ ID NO: 5) |
| GBSP24 ComD (441 aa) | putative sensor histidine kinase | MDLFGFGTVI VHFLIISHSY HFICKGQINR KELFVFGAYT LLTEIVFDFP LYILYLDGLG IERFLFPLGL YSYFRWMKQY ERDRGLFLSL LLSLLYESTH NFLSVTFSSI TGDNFVLQYH FPFFFVVTVL TYFVTLKIIY YFHLELAYFD EDYLYPPLKK VFFALLLLHI VSFVSDMVST IKHLNSFGSI LSSIVFISLL LTFFAMNSHK VQMEKEIALK QKKFEQKHLQ NYTDEIVGLY NEIRGFRHDY AGMLVSMQMA IDSGNLQEID RIYNEVLVKA NHKLRSDKYT YFDLNNIEDS ALRSLVAQSI VYARNNGVEF TLEVKDTITK LPIELLDLVR IMSVLLNNAV EGSADSYKKQ MEVAVIKMET ETVIVIQNSC KMTMTPSGDL FALGFSTKGR NRGVGLNNVK ELLDKYNNII LETEMEGSTF RQIIRFKREF E (SEQ ID NO: 6) |
| GBSP1 SecE (58 aa) | preprotein translocase subunit E | MRFIGDIFRL LKDTTWPTRK ESWRDFRSIM EYTAFFVVII YIFDQLIVSG LIRFINIF (SEQ ID NO: 7) |
| GBSP2 unannotated protein of CorA family (158 aa) | magnesium ion transporter | MKGVTNMTPE EMYLTERLDV QIAHFLKKSV QHRRRYKVLK ITEIVAGFLI AVFCAIPMPG DRYRLISVAL SSLGLLCEGI INLYNAKENW ISYQKTAQLL EKEKFLYQCQ TEKYAGKTKA FALFVKTCEG LISEEINQWE SIQSKEVAAS ADAPVKKE (SEQ ID NO: 8) |

TABLE 1A-continued

Polypeptides Encoded by Cold Spot Genes

| Polypeptide Designation/ Literature Acronym/ (length) | Protein Function | Amino Acid Sequence (SEQ ID NO:) |
|---|---|---|
| GBSP4 MalC (435 aa) | permease protein of maltodextrin ABC transporter | MKGVNMEKQQ PSKAALLSII PGLGQIYNKQ KAKGFIFLGV TIVFVLYFLA LATPELSNLI TLGDKPGRDN SLFMLIRGAF HLIFVIVYVL FYFSNIKDAH TIAKRINNGI PVPRTLKDMI KGIYENGFPY LLIIPSYVAM TFAIIFPVIV TLMIAFTNYD FQHLPPNKLL DWVGLTNFTN IWSLSTFRSA FGSVLSWTII WALAASTLQI VIGIFTAIIA NQPFIKGKRI FGVIFLLPWA VPAFITILTF SNMFNDSVGA INTQVLPILA KFLPFLDGAL IPWKTDPTWT KIALIMMQGW LGFPYIYVLT LGILQSIPND LYEAAYIDGA NAWQKFRNIT FPMILAVAAP TLISQYTFNF NNFSIMYLFN GGGPGSVGGG AGSTDILISW IYRLTTGTSP QYSMAAAVTL IISIIVISIS MIAFKKLHAF DMEDV (SEQ ID NO: 9) |
| GBSP6 MreD (164 aa) | rod shape-determining protein | MRQLKRVGVF LLLPFFVLID AHISQLLGSF FPHVHLASHF LFLFLLFETI EVSEYLYLVY CFVIGLVYDV YFFHLIGITT LLFILLGAFL HKLNSVILLN RWTRMLAMIV LTFLFEMGSY LLAFMVGLTV DSMSIFIVYS LVPTMILNFL WITVFQFIFE KYYL (SEQ ID NO: 10) |
| GBSP7 unannotated analogue of PTS subunit IID (271 aa) | phospho-transferase system (PTS) transporter | MTNSNYKLTK EDFNQINKRS LFTFQLGWNY ERMQASGYLY MILPQLRKMY GDGTPELKEM MKVHTQFFNT SPFFHTIIAG FDLAMEEKDG VGSKDAVNGI KTGLMGPFAP LGDTIFGSLV PAIMGSVAAT MAIAGQPWGI FLWIAVAVAY DIFRWKQLEF AYKEGVNLIN NMQSTLTALI DAASVLGVFM MGALVATVIN FEISYKLPIG EKMIDFQDIL NQIFPRLLPA IFTAFIFWLL GKKGMNSTKA IGIIIVLALA LSALGHFALG M (SEQ ID NO: 11) |
| GBSP8 AmiD (308 aa) | permease protein of oligopeptide ABC transporter | MSTIDKEKFQ FVKRDDFASE TIDAPAYSYW KSVFKQFMKK KSTVVMLGIL VAIILISFIY PMFSKFDFND VSKVNDFSVR YIKPNAEHWF GTDSNGKSLF DGVWFGARNS ILISVIATVI NLVIGVFVGG IWGISKSVDR VMMEVYNVIS NIPPLLIVIV LTYSIGAGFW NLIFAMSVTT WIGIAFMIRV QILRYRDLEY NLASRTLGTP TLKIVAKNIM PQLVSVIVTT MTQMLPSFIS YEAFLSFFGL GLPITVPSLG RLISDYSQNV TTNAYLFWIP LTTLVLVSLS LFVVGQNLAD ASDPRTHR (SEQ ID NO: 12) |
| GBSP9 unannotated analogue of PTS subunit IID (301 aa) | phospho-transferase system (PTS) transporter | MIQWWQILLL TLYSAYQICD ELTIVSSAGS PVFAGFITGL IMGDVTTGLL IGGNLQLFVL GVGTFGGASR IDATSGAVLA TAFSVSQGID APLAITTIAV PVAALLTYFD VLGRMTTTFF AHRVDAAIER FDYKGIERNY LLGAIPWALS RALPVFLFAL FGGAFVQSVV DFVEAYKWVA DGLTLAGRML PGLGFAILLR TLPVKRNLHY LAMGFGLTAM LTVLYSYVTG LGGAVAGIVG TLPAEVAEKI GFVNNFKGLS MIGISIVGIF LAVLHFKNSQ KVAVAAPSTP SESGEIEDDE F (SEQ ID NO: 13) |
| GBSP10 unannotated analogue of PnuC nicotinamide mononucleo-tide transporter (269 aa) | nicotinamide mononucleotide transporter analogue | MMHTYLQKKI ENIKTTLGEM SGGYRRMVAA MADLGFSGTM KAIWDDLFAH RSFAQWIYLL VLGSFPLWLE LVYEHRIVDW IGMICSLTGI ICVIFVSEGR ASNYLFGLIN SVIYLILALQ KGFYGEVLTT LYFTVMQPIG LLVWIYQAQF KKEKQEFVAR KLDGKGWTKY LSISVLWWLA FGPIYQSIGA NRPYRDSITD ATNGVGQILM TAVYREQWIF WAATNVFSIY LWWGESLQIQ GKYLIYLINS LVGWYQWSKA AKQNTDLLN (SEQ ID NO: 14) |
| GBSP11 unannotated analogue of SpoIIIJ family (274 aa) | protein involved in membrane insertion | MKKKLKLTSL LGLSLLIMTA CATNGVTSDI TAESADFWSK LVYFFAEIIR FLSFDISIGV GIILFTVLIR TVLLPVFQVQ MVASRKMQEA QPRIKALREQ YPGRDMESRT KLEQEMRKVF KEMGVRQSDS LWPILIQMPV ILALFQALSR YIPLFLKTGHFL WINLGSVDTT LVLPILAAVF TFLSTWLSNK ALSERNGATT AMMYGIPVLI FIFAVYAPGG VALYWTVSNA YQVLQTYFLN NPFKIIAERE AVVQAQKDLE NRKRKAKKKA QKTK (SEQ ID NO: 15) |
| GBSP13 PgsA (181 aa) | phosphatidyl transferase | MKKEQIPNLL TIGRILFIPI FIFILTIGNS IESHIVAAII FAVASITDYL DGYLARKWNV VSNFGKFADP MADKLLVMSA FIMLIELGMA PAWIVAVIIC RELAVTGLRL LLVETGGTIL AAAMPGKIKT FSQMFAIIFL LLHWTLLGQV LLYVALFFTI YSGYDYFKGS AYVFKGTFGS K (SEQ ID NO: 16) |

TABLE 1A-continued

Polypeptides Encoded by Cold Spot Genes

| Polypeptide Designation/ Literature Acronym/ (length) | Protein Function | Amino Acid Sequence (SEQ ID NO:) |
|---|---|---|
| GBSP17 ArsB (436 aa) | permease | MIHLIMISAI ALAIGIGYRT KINIGLLAIA FSYLIATTLM GLSPKELLHF WPTSLFFTIF SVSLFYNVAT TNGTLDVLAQ HILYRTRTHP NALYMILYLM ATLLSALGAG FFTTMAVCCP LAITLCQKAD KHPLIGAQAV NWGASGGANL ITSSSGIVFQ GLFKQMGWEE QAFSLGNHIF IVSIIYPLIV LLLLSCYSHY SKGRTNSSLT IDQPPLLSKV QRQTTLLMIS SMVLVWLFPL LHLIFPNIAW IATYQKTFDI GFVSILMVCL ALRLKLGKQE AILAKVPWAT IIMLCGMSLL MSLAVKSGLV TLIGHLMTTT IPHFWLPLFF CVIAGVMSLF SSTLSVVAPA LFPIIAIISA QNPQIDIHLL TTATVIGALS TNISPFSSAG SLIQLSLPNI EERGLAFKKQ IILGVPISLS LGLLTTWILI LLASLS (SEQ ID NO: 17) |
| GBSP18 MatE (411 aa) | multi- antimicrobial extrusion protein (MATE) | MGENFLQMLM GMVDSYLVAH LGLIAISGVS VAGNIITIYQ AIFIALGAAI SSVISKSIGQ KDQSKLAYHV TEALKITLLL SFLLGFLSIF AGKEMIGLLG TERDVAESGG LYLSLVGGSI VLLGLMTSLG ALIRATHNPR LPLYVSFLSN ALNILFSSLA IFVLDMGIAG VAWGTIVSRL VGLVILWSQL KLPYGKPTFG LDKELLTLAL PAAGERLMMR AGDVVIIALV VSFGTEAVAG NAIGEVLTQF NYMPAFGVAT ATVMLLARAV GEDDWKRVAS LSKQTFWLSL FLMLPLSFSI YVLGVPLTHL YTTDSLAVEA SVLVTLFSLL GTPMTTGTVI YTAVWQGLGN ARLPFYATSI GMWCIRIGTG YLMGIVLGWG LPGIWAGSLL DNGFRWLFLR YRYQRYMSLK G (SEQ ID NO: 18) |
| GBSP19 unannotated open reading frame (285 aa) | (function unknown) | MNYPKIDLKT IRQESKHFQA DTPRLFLLYI LPSMLVILSG FLNPLSRIHG TVLEQPFFSI LGQILQTYLF PLLVSFIGTI LLTSSVYATL TLMKDSKTEP SVKNSLALFD EERFSQTFLT LLLKRFYLFL WSIPNLLGIY LLFYSSFLAK KFVTLHPEFP NLDLSSVETE RFLMVFGLYF LASLILIIVG NILYIPQYYA YSQVEFLLCY SLDLGQVPPR RILKTSRSFM KGYKFQHFVL DLQLLPWYFL NWITFGIASF SLLPYIQCTK IMFYRAVLAR KRPKA (SEQ ID NO: 19) |
| GBSP20 CzcD (299 aa) | cation efflux system protein | MRNMKAKYAV WVAFFLNLTY AIVEFIAGGV FGSSAVLADS VHDLGDAIAI GISAFLETIS NREEDNQYTL GYKRFSLLGA LVTAVILVTG SVLVILENVT KILHPQPVND EGILWLGIIA ITINLLASLV VGKGKTKNES ILSLHFLEDT LGWVAVILMA IVLRFTDWYI LDPLLSLVIS FFILSKALPR FWSTLKIFLD AVPEGLDIKQ VKSGLERLDN VASLNQLNLW TMDALEKNAI VHVCLKEMEH METCKESIRI FLKDCGFQNI TIEIDADLET HQTHKRKVCD LERSYEHQH (SEQ ID NO: 20) |
| GBSP21 ComB (449 aa) | competence factor transport protein | MKPEFLESAE FYNRRYHNFS SSVIVPMALL LVFLLGFATV AEKEMSLSTR ATVEPSRILA NIQSTSNNRI LVNHLEENKL VKKGDLLVQY QEGAEGVQAE SYASQLDMLK DQKKQLEYLQ KSLQEGENHF PEEDKFGYQA TFRDYISQAG SLRASTSQQN ETIASQNAAA SQTQAEIGNL ISQTEAKIRD YQTAKSAIET GASLAGQNLA YSLYQSYKSQ GEENPQTKVQ AVAQVEAQIS QLESSLATYR VQYAGSGTQQ AYASGLSSQL ESLKSQHLAK VGQELTLLAQ KILEAESGKK VQGNLLDKGK VTASEDGVLH LNPETSDSSM VAEGALLAQL YPSLEREGKA KLTAYLSSKY VARIKVGDSV RYTTTHDAGN QLFLDSTITS IDATATKTEK GNFFKIEAET NLTSEQAEKL RYGVEGRLQM ITGKKSYLRY YLDQFLNKE (SEQ ID NO: 21) |

TABLE 1B

Allelic Variants of the Cold Spot Polypeptides (Predominant Sequences) in Table 1A

| Cold Spot Polypeptide presented in Table 1A (SEQ ID NO.) | number of alleles found/ % average aa pairwise homology (to predominant sequence) | Amino Acid Variations for Each Allele by Position in the Predominant Polypeptide Sequence in Table 1A |
| --- | --- | --- |
| GBSP3 allelic variants from predominant sequence (SEQ ID NO: 1) | 6 alleles found 99.89% average aa pairwise homology | 1. I205V (SEQ ID NO: 22)<br>2. I32V (SEQ ID NO: 23)<br>3. A231V (SEQ ID NO: 24)<br>4. T67A, L78I, V88A, D103G, A134V, R136K, S186T, I194V, A216T (SEQ ID NO: 25)<br>5. S141F (SEQ ID NO: 26)<br>6. T187I (SEQ ID NO: 27) |
| GBSP14 allelic variants from predominant sequence (SEQ ID NO: 2) | 14 alleles found 99.76% average aa pairwise homology | 1. L42Q (SEQ ID NO: 28)<br>2. L42Q, G88A (SEQ ID NO: 29)<br>3. Q84K (SEQ ID NO: 30)<br>4. L42Q, V109I (SEQ ID NO: 31)<br>5. L38F (SEQ ID NO: 32)<br>6. V360G (SEQ ID NO: 33)<br>7. L42Q, G88A, I271S (SEQ ID NO: 34)<br>8. E58K (SEQ ID NO: 35)<br>9. L275H (SEQ ID NO: 36)<br>10. L42Q, V326I (SEQ ID NO: 37)<br>11. T213I (SEQ ID NO: 38)<br>12. A23V, L42Q, G88A (SEQ ID NO: 39)<br>13. Q84K, S235L (SEQ ID NO: 40)<br>14. L42Q, G88A, A343T (SEQ ID NO: 41) |
| GBSP15 allelic variants from predominant sequence (SEQ ID NO: 3) | 10 alleles found 99.33% average aa pairwise homology | 1. S56N (SEQ ID NO: 42)<br>2. N53S (SEQ ID NO: 43)<br>3. M1V (SEQ ID NO: 44)<br>4. T18P (SEQ ID NO: 45)<br>5. M1V, N53S (SEQ ID NO: 46)<br>6. M1V, S56N (SEQ ID NO: 47)<br>7. A44T, S56N (SEQ ID NO: 48)<br>8. S56N, E72A (SEQ ID NO: 49)<br>9. S56N, P86L (SEQ ID NO: 50)<br>10. V55I, S56N (SEQ ID NO: 51) |
| GBSP22 allelic variants from predominant sequence (SEQ ID NO: 4) | 5 alleles found 99.94% average aa pairwise homology | 1. H154Y (SEQ ID NO: 52)<br>2. S234I (SEQ ID NO: 53)<br>3. A199S (SEQ ID NO: 54)<br>4. M162I (SEQ ID NO: 55)<br>5. L62F (SEQ ID NO: 56) |
| GBSP23 allelic variants from predominant sequence (SEQ ID NO: 5) | 12 alleles found 99.62% average aa pairwise homology | 1. V320I (SEQ ID NO: 57)<br>2. K211R (SEQ ID NO: 58)<br>3. W11S, V320I (SEQ ID NO: 59)<br>4. E143K, V320I (SEQ ID NO: 60)<br>5. W11G, T33A, N42S, D91E, R98Q, V301I, N385D (SEQ ID NO: 61)<br>6. Y8N, S302I, V320I, Q355P (SEQ ID NO: 62)<br>7. K211R, N283K, G284R (SEQ ID NO: 63)<br>8. K211R, T227A (SEQ ID NO: 64)<br>9. K211R, A290V (SEQ ID NO: 65)<br>10. K211R, V320I (SEQ ID NO: 66)<br>11. S186N (SEQ ID NO: 67)<br>12. W11G, T33A, N42S, D91E, R98Q, A147T, V301I, N385D (SEQ ID NO: 68) |
| GBSP24 allelic variants from predominant sequence (SEQ ID NO: 6) | 23 alleles found 98.37% average aa pairwise homology | 1. F4L, H21R, F22L, Q27R, F34Y, F47L, D48E, P50S, L51F, I53L, G58K, L59I, T106I, E151K (SEQ ID NO: 69)<br>2. F13L, S19N, F22L, E62A, R63I, E151K, A392S (SEQ ID NO: 70)<br>3. F4L, H21R, F22L, Q27R, F34Y, V35I, F47L, D48E, P50S, I53L, G58K, L59I, E151K, I374M (SEQ ID NO: 71)<br>4. F4L, H21R, F22L, Q27R, F34Y, F47L, D48E, P50S, L51F, I53L, G58K, L59I, T106I, E151K, M384I (SEQ ID NO: 72)<br>5. F22L, L51F, E62A, R63T, M77I, S104P, E151K (SEQ ID NO: 73)<br>6. G264S (SEQ ID NO: 74)<br>7. F22L, E62A, R63T, M77I, E151K (SEQ ID NO: 75)<br>8. F4L, H21R, F22L, Q27R, F34Y, F47L, D48E, P50S, L51F, I53L, G58K, L59I, E151K, I374M (SEQ ID NO: 76)<br>9. Y73N (SEQ ID NO: 77) |

TABLE 1B-continued

Allelic Variants of the Cold Spot Polypeptides (Predominant Sequences) in Table 1A

| Cold Spot Polypeptide presented in Table 1A (SEQ ID NO.) | number of alleles found/ % average aa pairwise homology (to predominant sequence) | Amino Acid Variations for Each Allele by Position in the Predominant Polypeptide Sequence in Table 1A |
|---|---|---|
| | | 10. F13L, S19N, F22L, E62A, R63I, E151K (SEQ ID NO: 78)<br>11. S19N, F22L, E62A, R63T, M77I, E151K, A392S (SEQ ID NO: 79)<br>12. F4L, H21R, F22L, Q27R, F34Y, F47L, D48E, P50S, L51F, I53L, G58K, L59I (SEQ ID NO: 80)<br>13. L3F, G5L, F6L, G7V, T8D, V9L, V11L, H12Y, H21R, F22L, G26D, V35F, F47L, L51F, I53L, E62A, R63T, H120Y, F121G, P122L, E151K, I272V, E439K (SEQ ID NO: 81)<br>14. A164V (SEQ ID NO: 82)<br>15. M253T (SEQ ID NO: 83)<br>16. A280X, I374V (SEQ ID NO: 84)<br>17. S104Y (SEQ ID NO: 85)<br>18. G7E, S104Y (SEQ ID NO: 86)<br>19. S19N, F22L, E62A, R63T, M77I, E151K, E371G, A392S (SEQ ID NO: 87)<br>20. F22L, E62A, R63T, M77I, E151K, I272V (SEQ ID NO: 88)<br>21. F22L, M77I, T99I, E151K, V171I, L254F (SEQ ID NO: 89)<br>22. F4L, H21R, F22L, Q27R, F34Y, F47L, D48E, P50S, L51F, I53L, Y55S, G58K, L59I, E151K (SEQ ID NO: 90)<br>23. L3F, G5L, F6L, G7V, T8D, V9L, V11L, H12Y, H21R, F22L, G26D, V35F, F47L, L51F, I53L, E62A, R63T, H120Y, F121G, P122L, I272V, E439K (SEQ ID NO: 91) |
| GBSP1 allelic variant from predominant sequence (SEQ ID NO: 7) | 1 allele found 99.91% average aa pairwise homology | 1. R9K (SEQ ID NO: 92) |
| GBSP2 allelic variants from predominant sequence (SEQ ID NO: 8) | 3 alleles found 99.90% average aa pairwise homology | 1. N89H, K102R, D152E, V155G (SEQ ID NO: 93)<br>2. T127A (SEQ ID NO: 94)<br>3. V20I (SEQ ID NO: 95) |
| GBSP4 allelic variants from predominant sequence (SEQ ID NO: 9) | 8 alleles found 99.92% average aa pairwise homology | 1. I422V (SEQ ID NO: 96)<br>2. G39S (SEQ ID NO: 97)<br>3. D64N (SEQ ID NO: 98)<br>4. G174S (SEQ ID NO: 99)<br>5. A332T (SEQ ID NO: 100)<br>6. G39S, W201L (SEQ ID NO: 101)<br>7. N5I, T53A, I86V, S94A, T179S, L269F (SEQ ID NO: 102)<br>8. N5I, T53A, I86V, R114L, S193A, G371A (SEQ ID NO: 103) |
| GBSP6 allelic variants from predominant sequence (SEQ ID NO: 10) | 5 alleles found 99.69% average aa pairwise homology | 1. V70I (SEQ ID NO: 104)<br>2. Y68H (SEQ ID NO: 105)<br>3. V67I (SEQ ID NO: 106)<br>4. I64T (SEQ ID NO: 107)<br>5. T79A, M105I, L111M, T112S, E116D, S119T, L122F, F124L, M125V, V130L, M133L, S134P, T144S, F149L, L150V, I152M, T153L, V154I, K161R (SEQ ID NO: 108) |
| GBSP7 allelic variants from predominant sequence (SEQ ID NO: 11) | 7 alleles found 99.88% average aa pairwise homology | 1. G117A (SEQ ID NO: 109)<br>2. A260T (SEQ ID NO: 110)<br>3. S20R (SEQ ID NO: 111)<br>4. V198M, L269F (SEQ ID NO: 112)<br>5. A263T (SEQ ID NO: 113)<br>6. M49I, L207W, P208A, L264F, H266K, A268V (SEQ ID NO: 114)<br>7. S93A, N167S, V198L, I203V, Q222S, L264F, H266K, A268V, -272G, -273A (SEQ ID NO: 115) |

TABLE 1B-continued

Allelic Variants of the Cold Spot Polypeptides (Predominant Sequences) in Table 1A

| Cold Spot Polypeptide presented in Table 1A (SEQ ID NO.) | number of alleles found/ % average aa pairwise homology (to predominant sequence) | Amino Acid Variations for Each Allele by Position in the Predominant Polypeptide Sequence in Table 1A |
|---|---|---|
| GBSP8 allelic variants from predominant sequence (SEQ ID NO: 12) | 5 alleles found 99.78% average aa pairwise homology | 1. V79I (SEQ ID NO: 116)<br>2. L122V (SEQ ID NO: 117)<br>3. A216V (SEQ ID NO: 118)<br>4. V79I, G106V (SEQ ID NO: 119)<br>5. V79I, G168R (SEQ ID NO: 120) |
| GBSP9 allelic variants from predominant sequence (SEQ ID NO: 13) | 10 alleles found 99.86% average aa pairwise homology | 1. E248Q (SEQ ID NO: 121)<br>2. D181Y (SEQ ID NO: 122)<br>3. A283V (SEQ ID NO: 123)<br>4. F131Y, S168H, F172L, E174T, A175E, K177Q, V179I (SEQ ID NO: 124)<br>5. I41V (SEQ ID NO: 125)<br>6. T47I (SEQ ID NO: 126)<br>7. F131Y (SEQ ID NO: 127)<br>8. A164E, S168G, E174T, A175E, K177Q (SEQ ID NO: 128)<br>9. A91T, P92A, F172L, I238V, V239I, A244K, E245D (SEQ ID NO: 129)<br>10. A91T, P92A, A164E, S168H, E174T, A175K, K177Q, A244K, E245D (SEQ ID NO: 130) |
| GBSP10 allelic variants from predominant sequence (SEQ ID NO: 14) | 9 alleles found 99.84% average aa pairwise homology | 1. G164D (SEQ ID NO: 131)<br>2. L268P (SEQ ID NO: 132)<br>3. Q186R (SEQ ID NO: 133)<br>4. G38E (SEQ ID NO: 134)<br>5. A212T (SEQ ID NO: 135)<br>6. T168A (SEQ ID NO: 136)<br>7. W80C (SEQ ID NO: 137)<br>8. Q149R (SEQ ID NO: 138)<br>9. M2I (SEQ ID NO: 139) |
| GBSP11 allelic variants from predominant sequence (SEQ ID NO: 15) | 12 alleles found 99.81% average aa pairwise homology | 1. G25E, H158Q (SEQ ID NO: 140)<br>2. E47K (SEQ ID NO: 141)<br>3. V67I (SEQ ID NO: 142)<br>4. S166G (SEQ ID NO: 143)<br>5. L41S ( SEQ ID NO: 144)<br>6. E47K, R70C (SEQ ID NO: 145)<br>7. E47K, A255T (SEQ ID NO: 146)<br>8. A222T, V253A (SEQ ID NO: 147)<br>9. F211L (SEQ ID NO: 148)<br>10. P102S (SEQ ID NO: 149)<br>11. T19A (SEQ ID NO: 150)<br>12. G25E, H158Q, F243L (SEQ ID NO: 151) |
| GBSP13 allelic variants from predominant sequence (SEQ ID NO: 16) | 8 alleles found 99.61% average aa pairwise homology | 1. M83V (SEQ ID NO: 152)<br>2. M83I (SEQ ID NO: 153)<br>3. I22L (SEQ ID NO: 154)<br>4. A122S (SEQ ID NO: 155)<br>5. M124I (SEQ ID NO: 156)<br>6. L84F (SEQ ID NO: 157)<br>7. A90D (SEQ ID NO: 158)<br>8. A122S, G169S (SEQ ID NO: 159) |
| GBSP17 allelic variants from predominant sequence (SEQ ID NO: 17) | 22 alleles found 99.51% average aa pairwise homology | 1. Q255R (SEQ ID NO: 160)<br>2. V68F, T70I, H89Y, Q255R, T320S (SEQ ID NO: 161)<br>3. V68F, T70I, H89Y, E170D, T320S (SEQ ID NO: 162)<br>4. A92T (SEQ ID NO: 163)<br>5. T70I, Q255R (SEQ ID NO: 164)<br>6. V68F, T70I, H89Y, R204K, T320S (SEQ ID NO: 165)<br>7. V68F, T70I, H89Y, T320S (SEQ ID NO: 166)<br>8. G108S (SEQ ID NO: 167)<br>9. H89Y (SEQ ID NO: 168)<br>10. Q255R, H315Q (SEQ ID NO: 169)<br>11. T37I, T70I, H89Y (SEQ ID NO: 170)<br>12. T70I, H89Y (SEQ ID NO: 171)<br>13. V68F, T70I, H89Y (SEQ ID NO: 172)<br>14. T70I, H89Y, Q255R, T319I, T320S (SEQ ID NO: 173)<br>15. T70I, H89Y, Q255R, T320S (SEQ ID NO: 174)<br>16. R273K (SEQ ID NO: 175)<br>17. A116V (SEQ ID NO: 176) |

TABLE 1B-continued

Allelic Variants of the Cold Spot Polypeptides (Predominant Sequences) in Table 1A

| Cold Spot Polypeptide presented in Table 1A (SEQ ID NO.) | number of alleles found/ % average aa pairwise homology (to predominant sequence) | Amino Acid Variations for Each Allele by Position in the Predominant Polypeptide Sequence in Table 1A |
|---|---|---|
| | | 18. A249V (SEQ ID NO: 177)<br>19. Y18F, T113A (SEQ ID NO: 178)<br>20. T70I (SEQ ID NO: 179)<br>21. T70I, H89Y, Q255R, T320S, G422E (SEQ ID NO: 180)<br>22. V68F, T70I, T86I, H89Y, Q255R, T320S, G404A (SEQ ID NO: 181) |
| GBSP18 allelic variants from predominant sequence (SEQ ID NO: 18) | 21 alleles found 99.50% average aa pairwise homology | 1. V177L, M373L (SEQ ID NO: 182)<br>2. V177L, S408N (SEQ ID NO: 183)<br>3. A169T, V177L, P197L, V344I, M373L (SEQ ID NO: 184)<br>4. V177L (SEQ ID NO: 185)<br>5. V177L, S408I (SEQ ID NO: 186)<br>6. A169T, V177L, P197L, S408I (SEQ ID NO: 187)<br>7. S408N (SEQ ID NO: 188)<br>8. V177L, P197L (SEQ ID NO: 189)<br>9. S408I (SEQ ID NO: 190)<br>10. P142L (SEQ ID NO: 191)<br>11. A237T, S408N (SEQ ID NO: 192)<br>12. V177L, G195E (SEQ ID NO: 193)<br>13. G195E (SEQ ID NO: 194)<br>14. V177L, P197L, T260M (SEQ ID NO: 195)<br>15. L159X (SEQ ID NO: 196)<br>16. A317V (SEQ ID NO: 197)<br>17. K203R, S408I (SEQ ID NO: 198)<br>18. V177L, S297Y, M373L (SEQ ID NO: 199)<br>19. A169T, V177L, P197L, P295L, S408I (SEQ ID NO: 200)<br>20. Q7H, A169T, V177L, T285I, S408I (SEQ ID NO: 201)<br>21. Q7H, A169T, G170S, T285I, S408I (SEQ ID NO: 202) |
| GBSP19 allelic variants from predominant sequence (SEQ ID NO: 19) | 17 alleles found 99.37% average aa pairwise homology | 1. G40S, T67A (SEQ ID NO: 203)<br>2. G40S, T67A, H237R (SEQ ID NO: 204)<br>3. T67A, Y210H (SEQ ID NO: 205)<br>4. G40S, H237R (SEQ ID NO: 206)<br>5. G40S, T67A, V239I (SEQ ID NO: 207)<br>6. G40S (SEQ ID NO: 208)<br>7. G40S, T67A, Y140H, N161S (SEQ ID NO: 209)<br>8. G40S, T67A, R275Q (SEQ ID NO: 210)<br>9. G40S, T67A, S183G, H237R (SEQ ID NO: 211)<br>10. G40S, T67A, S75F, H237R (SEQ ID NO: 212)<br>11. G40S, T67A, S75F, K150Q, E170D, H237R (SEQ ID NO: 213)<br>12. L245I (SEQ ID NO: 214)<br>13. G78R (SEQ ID NO: 215)<br>14. T67A, V153A, Y210H (SEQ ID NO: 216)<br>15. R12H, L27F, G40S (SEQ ID NO: 217)<br>16. T67A, H237R (SEQ ID NO: 218)<br>17. T67A, H237R, I271L (SEQ ID NO: 219) |
| GBSP20 allelic variants from predominant sequence (SEQ ID NO: 20) | 20 alleles found 99.31% average aa pairwise homology | 1. A47V, P189S (SEQ ID NO: 220)<br>2. A47V, L81V, G214D (SEQ ID NO: 221)<br>3. T58L, A222V (SEQ ID NO: 222)<br>4. V30I, G45V, S143N, P189S (SEQ ID NO: 223)<br>5. P189S (SEQ ID NO: 224)<br>6. S143N, P189S (SEQ ID NO: 225)<br>7. I52M, H250Y (SEQ ID NO: 226)<br>8. T83I, P189S (SEQ ID NO: 227)<br>9. V30I, G45V, A222V (SEQ ID NO: 228)<br>10. A222V (SEQ ID NO: 229)<br>11. A47V, A222V (SEQ ID NO: 230)<br>12. V10A, G45V (SEQ ID NO: 231)<br>13. A47V (SEQ ID NO: 232)<br>14. A187V (SEQ ID NO: 233)<br>15. V30I, G45V, L81V, V131I, A222V (SEQ ID |

TABLE 1B-continued

Allelic Variants of the Cold Spot Polypeptides (Predominant Sequences) in Table 1A

| Cold Spot Polypeptide presented in Table 1A (SEQ ID NO.) | number of alleles found/ % average aa pairwise homology (to predominant sequence) | Amino Acid Variations for Each Allele by Position in the Predominant Polypeptide Sequence in Table 1A |
|---|---|---|
| | | 16. V30I, G45V, L81V, A222V (SEQ ID NO: 235)
17. V30I, G45V, L125M (SEQ ID NO: 236)
18. V30I, A222V, I260N (SEQ ID NO: 237)
19. V10A, A21T, A47V, A222V (SEQ ID NO: 238)
20. A47V, L81V, G214D, G266V (SEQ ID NO: 239) |
| GBSP21 allelic variants from predominant sequence (SEQ ID NO: 21) | 34 alleles found 99.13% average aa pairwise homology | 1. A202T, V311I, Y360D (SEQ ID NO: 240)
2. I198M, G206S, V311I, Y360D (SEQ ID NO: 241)
3. S22R, A28S, V40F, M45I, T227I, V311I, Y360D (SEQ ID NO: 242)
4. S182N, I198M, G206S, V311I, Y360D (SEQ ID NO: 243)
5. V53I, I198M, G206S, G257A, V311I, Y360D (SEQ ID NO: 244)
6. I198M, G206S, V311I, Y360D (SEQ ID NO: 245)
7. E125G, V311I, A335T, Y360D (SEQ ID NO: 246 )
8. V311I, Y360D (SEQ ID NO: 247)
9. D85E, A94V, A149E, A194V, V311I, Y360D (SEQ ID NO: 248)
10. T227I, V311I, Y360D (SEQ ID NO: 249)
11. A94T, I198M, G206S, V311I, Y360D (SEQ ID NO: 250)
12. A175S, V311I, Y360D, L382F (SEQ ID NO: 251)
13. A194V, V311I, Y360D, T410I (SEQ ID NO: 252)
14. A202T, T286S, V311I, A335T, Y360D (SEQ ID NO: 253)
15. A175S, V311I, Y360D (SEQ ID NO: 254)
16. H129R, S182N, K195Q, I198M, G206S, V311I, Y360D (SEQ ID NO: 255)
17. G84E, S182N, I198M, G206S, V311I, Y360D (SEQ ID NO: 256)
18. I198M, G206S, K300N, V311I, Y360D (SEQ ID NO: 257)
19. A202T, G282C, V311I, Y360D (SEQ ID NO: 258)
20. L213F, V311I, Y360D (SEQ ID NO: 259)
21. A202T (SEQ ID NO: 260)
22. S182N, K195Q, I198M, G206S, V311I, Y360D (SEQ ID NO: 261)
23. I198M, G206S, V311I, A350T, Y360D (SEQ ID NO: 262)
24. A175S, I198M, G206S, V311I, Y360D (SEQ ID NO: 263)
25. V40I, A202T, G206S, V311I, Y360D (SEQ ID NO: 264)
26. A202T, V311I, Y360D, L382F (SEQ ID NO: 265)
27. E125G, I198M, V311I, Y360D (SEQ ID NO: 266)
28. A175S, V311I, Y360D (SEQ ID NO: 267)
29. Y138H, L152I, A175S, V311I, Y360D (SEQ ID NO: 268)
30. A175S, V311I, Y360D, T410I, L428I (SEQ ID NO: 269)
31. A175S, L213F, A231V, V311I, Y360D (SEQ ID NO: 270)
32. L75S (SEQ ID NO: 271)
33. A149V, A194V, V311I, Y360D, T410I (SEQ ID NO: 272)
34. A194V, V311I, Y360D (SEQ ID NO: 273) |

Alignment and analysis of genetic sequence data from isolates of *S. pneumoniae* present in the publicly accessible National Center for Biotechnology Information (NCBI) GenBank database (National Center for Biotechnology Information (NCBI), U.S. National Library of Medicine, 8600 Rockville Pike, Bethesda Md., 20894, USA) was performed using the MEGABLAST® program for aligning nucleotide sequences (Altschul et al., *J. Mol. Biol.,* 215(3): 403-410 (1990); Zhang et al., *J. Comput. Biol.,* 7 (1/2): 203-214 (2000)) and BLASTP for aligning amino acid sequences (Altschul et al. (1990)) to determine the degree of conservation across the genomic sequences. Eventually 231 complete *S. pneumoniae* genomes were analyzed. This analysis involved aligning over 10 million nucleotide sequences and over 3 million corresponding amino acid sequences. Where possible, corresponding cold spot proteins from non-fully sequenced pneumococcal genomes in the Microbial Genomes database of NCBI were also included in these alignment studies. Thus, for many of the disclosed cold spot polypeptides, sequence homology data included more than the 231 related sequences from the fully sequenced pneumococcal genomes.

By this alignment analysis, 16 putative surface-expressed antigens encoded by cold spot genes were identified that had an average amino acid pairwise sequence homology of 99.50% or greater. A group of the top 21 cold spot genes most likely to be essential by locus criticality (e.g., proximity to essential rrn operons, see, for example, Bouchet et al., *Clin. Microbiol. Rev.,* 21: 2262-2273 (2008)) and/or function, encoding polypeptides corresponding to SEQ ID NOS:1-21 in Table 1A (and their alleles, SEQ ID NOs:22-273 in Table 1B), were selected for further characterization. Using dot blot DNA hybridization, the top 21 cold spot genes were also subjected to a survey for species-wide commonality (presence) across the evolutionary diversity of a worldwide phylogenetically organized collection of more than 2500 pneumococcal isolates from North America, South America, Europe, Africa, South Asia, and China. The results confirmed that the 21 genes were common to ("present in", "in-common" among) the more than 2500 *S. pneumoniae* isolates in the inventor's laboratory collection of isolates, indicating that all 21 of the *S. pneumoniae* proteins were encoded in the genome of every known strain of *S. pneumoniae*—in other words, such cold spot genes were universally present in the species.

Production of Cold Spot Polypeptides and Fragments Thereof

Cold spot polypeptides, and fragments thereof, of the present invention may be produced by any of a number of techniques known in the art including recombinant genetic engineering, chemical synthesis, and cell-free translation.

For example, a cold spot polypeptide, or immunogenic fragment thereof, can be produced using methods of conventional recombinant nucleic acid technology to express a cold spot gene or portion thereof in cultured cells. See, for example, Sambrook et al., eds., *Molecular Cloning: a Laboratory Manual* (3d ed.) (Cold Spring Harbor Press, 2001); Ausubel et al. (eds.), *Current Protocols in Molecular Biology* (John Wiley & Sons, Inc., New York, 1994); Innis et al. (eds.), *PCR Protocols* (Academic Press, New York, 1990). For example, a nucleic acid molecule encoding a cold spot polypeptide, or fragment thereof, may be inserted into an expression vector, such that the open reading frame is properly oriented for the expression of the encoded protein under the control of a promoter of choice that is compatible with a particular eukaryotic or prokaryotic host cell. In addition to a promoter, an expression vector should also contain the necessary elements for the transcription of the inserted nucleic acid encoding the desired polypeptide.

By way of non-limiting example, for expression of a cold spot polypeptide or fragment thereof in host cells, an expression vector encoding a cold spot polypeptide, or desired fragment thereof, can be introduced into a host cell by standard techniques. A wide variety of techniques may be used for the introduction of exogenous DNA into a prokaryotic or eukaryotic host cell, including, but not limited to, electroporation (for example, Neumann et al., *EMBO J.,* 1(7):841-845 (1982); Wong et al., *Biochem. Biophys. Res. Commun.,* 107(2):584-587 (1982); Potter et al., *Proc. Natl. Acad. Sci. USA,* 81(22):7161-7165 (1984), incorporated herein by reference), calcium-phosphate precipitation, DEAE-dextran transfection, lipofection, protoplast fusion, particle bombardment, polyethylene glycol-mediated DNA uptake (see, for example, Sambrook et al. (eds.), *Molecular Cloning: A Laboratory Manual, second edition* (Cold Spring Harbor Laboratory Press, Cold Spring Harbor, N.Y. (1989), which is hereby incorporated by reference in its entirety), and fusion of protoplasts with other entities (for example, minicells, other cells, liposomes, or other fusible lipid-surfaced bodies that contain the desired cold spot gene or coding sequence). See, for example, Fraley et al., *Proc. Natl. Acad. Sci. USA,* 79(6): 1859-1863 (1982), which is hereby incorporated by reference in its entirety. Such methods of introduction of DNA into a target cell will be variously referred to in the art as, e.g., "transformation", "conjugation", "transduction", "transfection", etc., and all such methods and techniques are contemplated and may be appropriately used according to the desires of the practitioner.

Using standard methods, such as described above, a nucleic acid molecule encoding a cold spot polypeptide, or fragment thereof (for example, an immunogenic fragment), can be cloned into an expression vector, which in turn is introduced into a host cell for expression of the encoded cold spot polypeptide or fragment thereof. A variety of expression systems comprising suitable expression vectors and host cells are available in the art for expressing a recombinant nucleic acid encoding a cold spot polypeptide or fragment thereof. Examples of suitable host cells include, but are not limited to, bacterial cells, fungal cells, mammalian cells, insect cells, plant cells, and protist cells. For expression of large quantities of cold spot polypeptides, prokaryotic hosts will typically be employed. Suitable prokaryotic host cells useful in the invention include, but are not limited to, *Escherichia coli, Bacillus* (for example, *B. subtilis*), *Streptomyces* (for example, *S. lividans*), *Salmonella*, and *Pseudomonas. Escherichia coli* is preferred. The use of a *Streptococcus* (for example, *S. pneumoniae*) strain as a host is possible but not preferred, as it would require separation of the recombinantly expressed cold spot polypeptide from other streptococcal proteins.

Under certain circumstances, expression in a eukaryotic host cell may be favored. Preferred mammalian host cells for expressing a recombinant cold spot polypeptide or fragment thereof of the invention include, but are not limited to, Chinese Hamster Ovary (CHO cells) (including dhfr– CHO cells, described in Urlaub and Chasin, *Proc. Natl. Acad. Sci. USA,* 77:4216-4220 (1980)) preferably used with a DHFR selectable marker as described in Kaufman and Sharp, *J. Mol. Biol.,* 159: 601-621 (1982)), NS0 myeloma cells, COS cells, and SP2 cells.

By way of non-limiting example, when a recombinant expression vector carrying an inserted *S. pneumoniae* cold spot gene is introduced into a host cell, the cold spot polypeptide is produced by culturing the host cell for a period of time sufficient to allow for expression of the cold spot polypeptide in the host cells. Cold spot polypeptides can be recovered from the cultured host cells using standard protein purification methods and then formulated into immunogenic compositions or vaccines following standard methods and protocols in the art.

As should be clear from the above comments, a variety of methods are available in the art for the skilled practitioner to express cold spot polypeptides or fragments thereof. Alternatively, in view of the full disclosure herein of the amino acid sequence encoded by each cold spot gene (Table 1A and Table 1B), a cold spot polypeptide or fragment thereof may also be produced to order from a contract research organization. Similarly, polyclonal or monoclonal antibodies that bind to a particular cold spot polypeptide or antigenic fragment thereof may be produced using well known immunization techniques, which may also be performed as a service by contract research organizations, such as ProMab (Richmond, Calif.) or GenScript (Piscataway, N.J.).

Compositions Comprising Cold Spot Polypeptides and Antigenic Fragments Thereof

The polypeptides encoded by the recombinational cold spot genes described above ("cold spot polypeptides") are useful in immunogenic compositions that are capable of eliciting an immune response to the cold spot polypeptide or an antigenic fragment thereof (such as the isolated cold spot extracellular domain). An immunogenic composition of the invention comprises at least one cold spot polypeptide or an immunogenic fragment thereof. Such compositions may also advantageously include a pharmaceutically acceptable carrier (vehicle) or diluent and/or an adjuvant to enhance elicitation of an immune response. Immunogenic compositions of the invention may be used to raise polyclonal or monoclonal antibodies capable of specific binding to the cold spot polypeptide, or an immunogenic fragment thereof, using standard methods and compositions known in the art.

For purposes of vaccine development, cold spot polypeptides comprising the native amino acid sequence of an in-common *S. pneumoniae* surface antigen, in particular the extracellular domain of the surface antigen, or an immunogenic fragment thereof, are preferred. Preferably, the predominant cold spot amino acid sequence among known alleles will be used, but other allelic sequences may be used and are expected to be effective, due to the extremely high sequence similarity among alleles, exceeding 95%, and usually exceeding 99%, average amino acid sequence pairwise homology, among the 231 known *S. pneumoniae* genomes. Although less preferred, a minor degree of artificial mutation from the predominant native amino acid sequence can be tolerated without destroying the desired immunogenicity that produces antibodies recognizing the native antigenic polypeptide and natural pneumococcal cells. Such artificial mutations may be introduced for other reasons, such as increasing recombinant expression, avoiding intracellular protease digestion, improving solubility, aiding purification, and the like; and, accordingly, amino acid variants of the aforementioned cold spot polypeptides that maintain at least 90%, preferably 95%, and most preferably 98% or more sequence identity with the predominant native amino acid sequence for any given cold spot polypeptide may be used, where the variant polypeptide maintains immunogenicity, i.e., the ability to elicit production of antibodies reactive with the naturally occurring cold spot polypeptide.

An immunogenic composition comprising a cold spot polypeptide, or immunogenic fragment thereof, may be used in any of a variety of methods known in the art for raising polyclonal or monoclonal antibodies to the polypeptide or antigenic fragment thereof. Such methods will typically require administration to a non-human animal (for example, mouse, rat, rabbit, guinea pig, hamster, chicken) of a composition comprising a cold spot polypeptide, or antigenic fragment thereof, that is dissolved, suspended, or otherwise contained within a physiologically acceptable vehicle and may further comprise one or more additional physiologically acceptable components including, but not limited to, an adjuvant and/or an excipient.

Preferred immunogenic compositions and vaccines according to the invention comprise a cold spot polypeptide, or an immunogenic fragment thereof, as described herein, and may further comprise one or more pharmaceutically acceptable components, such as a pharmaceutically acceptable vehicle, adjuvant, excipient, or other ingredient. Immunogenic compositions and vaccines described herein are understood to be dispersed in sterile vehicles and used under sterile conditions to avoid introduction of infectious agents and/or undesirable or interfering substances into the human or non-human subject.

Pharmaceutical vehicles or pharmaceutical carriers useful in compositions described herein for eliciting an immune response or producing antibodies to a cold spot polypeptide, or immunogenic fragment thereof, are well known to practitioners in the art and include, but are not limited to, sterile water; pyrogen-free preparations of sterile water; saline; phosphate buffered saline (PBS); dextrose; glycerol; ethanol; and combinations thereof. In some compositions, it may be preferable to include physiological or pharmaceutically acceptable isotonic agents, for example, but not limited to, sugars; polyalcohols, such as mannitol or sorbitol; sodium chloride; and combinations thereof. Pharmaceutically acceptable carriers may further comprise minor amounts of auxiliary substances such as wetting or emulsifying agents, preservatives, or buffers to enhance the shelf life or effectiveness of an immunogenic composition or vaccine.

Excipients may also be used in pharmaceutical compositions according to the invention. An excipient is generally any compound or combination of compounds that provides a desired feature to a composition. The pH may be adjusted in a composition as necessary, for example, to promote or maintain solubility of component ingredients, to maintain stability of one or more ingredients in a composition, and/or to deter undesired growth of microorganisms that inadvertently may be introduced at some point during the preparation or use of a composition or vaccine.

Particularly with respect to raising polyclonal antibodies in non-human animals, a polypeptide may be conjugated to or otherwise associated with a carrier protein or matrix that enhances the immune response to the polypeptide. The term "carrier protein" in the context of an immunogenic composition refers to a protein that elicits an immune response to itself and/or to an antigen conjugated or otherwise associated with or complexed with such carrier protein. In a conjugate immunogenic composition, an antigen is reacted with a carrier protein, so that the antigen and carrier protein are covalently linked to each other by design. Preferably, a carrier protein contains epitopes recognized by a helper T-cell to stimulate B cells that produce antibodies to the antigen that is conjugated to the carrier protein. Carrier proteins that are useful in raising antibodies to a polypeptide that is conjugated or otherwise associated with such carrier proteins include, but are not limited to, keyhole limpet hemocyanin (KLH), blue carrier protein, ovalbumin, bovine serum albumin, and derivatives thereof (for example, pegylated forms). Also encompassed by the definition of a "carrier protein" are multi-antigenic peptides (MAPs), which are branched peptides having a plurality of reactive sites to which antigenic molecules may be linked Preferably, a MAP includes lysine (Lys) residues that can link to antigenic molecules. Exemplary carrier proteins may also include, but are not limited to, bacterial toxins and toxoids, which may be mutated or chemically treated, for example, to reduce undesirable reactogenicity with tissues of an individual. Such carrier proteins include, for example, diphtheria toxin or a non-toxic mutant thereof, for example, diphtheria toxoid; tetanus toxin, or a non-toxic mutant thereof, for example, tetanus toxoid; *Pseudomonas aeruginosa* exotoxin A, or a non-toxic mutant thereof; cholera toxin B subunit; tetanus toxin fragment C; bacterial flagellin; pneumolysin; listeriolysin O (LLO, and related molecules); an outer membrane protein of *Neisseria meningitidis*; *Pseudomonas aeruginosa* Hcp1 protein; *Escherichia coli* heat labile enterotoxin; Shiga-like toxin; human LTB protein; the dominant negative inhibitor mutant (DNI) of the Protective Antigen of *Bacillus anthracis*; and *Escherichia coli* beta-galactosidase.

A polypeptide can be conjugated to a carrier protein using standard protocols and cross-linking (or "coupling") agents known in the art. Some cross-linking agents are "homobifunctional" coupling agents that have two identical reactive sites to link a polypeptide to a carrier protein. Some cross-linking agents are "heterobifunctional" coupling agents that have two different reactive sites to link a polypeptide (at one site) with a carrier protein (at the other different site). Examples of cross-linking agents that may be used for conjugating a polypeptide to a carrier protein for raising antibody to the polypeptide include, but are not limited to, any one of glutaraldehyde, maleimide agents (for example, m-maleimidobenzoyl-N-hydroxysuccinimide ester), carbodiimide agents, and bis-diazotized benzidine. Those skilled in the art will be able to select appropriate cross-linking agents and cross-linking chemistries to effect conjugation of desired antigens with a chosen carrier protein. For example, glutaraldehyde is a suitable homobifunctional cross-linking agent for creating cross-links between the $NH_2$-functional side-chains of lysine residues in the polypeptide antigen and a carrier protein.

Notwithstanding the foregoing discussion, the immunogenic cold spot polypeptides of the present invention will typically not be conjugated or cross-linked to a carrier protein, as this would not be necessary to render them immunogenic. In fact, it is contemplated that the cold spot polypeptides disclosed herein may themselves be useful as a carrier protein for conjugation with weakly immunogenic antigens, such as *S. pneumoniae* capsular polysaccharides. Additionally, the cold spot polypeptides of the present invention may be admixed with conventional conjugate vaccines (e.g., PREVNAR®-7, PREVNAR®-13) or capsular polysaccharide antigen compositions (e.g., PNEUMOVAX®-23) to produce a compound vaccine composition. Such compound compositions would be expected to have extended range—vaccination coverage extending beyond the conjugate vaccine or capsular polysaccharide vaccine components used in the admixture.

Methods for the preparation and formulation of vaccine compositions are well known to those skilled in the art. The choice of ingredients will for instance vary depending on the intended administration route of the composition. For example, vaccine compositions for parenteral administration may include pharmaceutically acceptable sterile aqueous or non-aqueous solvents, suspensions, and emulsions. Examples of non-aqueous solvents include, but are not limited to, propylene glycol, polyethylene glycol, vegetable oils (such as olive oil), and injectable organic esters such as ethyl oleate. Topical carriers or occlusive dressings can be used to increase skin permeability and enhance antigen absorption for topically applied vaccine compositions. Liquid dosage forms for oral administration may generally comprise, for example, a liposome composition containing the liquid dosage form. Suitable forms for suspending liposomes include emulsions, suspensions, solutions, syrups, and elixirs containing inert diluents commonly used in the art, such as purified sterile water.

An immunogenic composition or vaccine comprising an *S. pneumoniae* cold spot polypeptide, or immunogenic fragment thereof, of the invention may also comprise any of a variety of known adjuvants that enhance an immune response, especially production of antibodies, to an antigen. Examples of adjuvants that may be used in an immunogenic or vaccine composition comprising an *S. pneumoniae* cold spot polypeptide, or an immunogenic fragment thereof, described herein include, but are not limited to:

(1) Freund's complete adjuvant (FCA) or Freund's incomplete adjuvant (HA) may be employed to boost an immune response to a polypeptide in a non-human animal in order enhance the level (titer) of antibody produced to the polypeptide. FCA comprises a water in mineral oil emulsion and inactivated mycobacteria. HA comprises a water in mineral oil emulsion without the mycobacteria component of FCA. FCA and HA are particularly useful when antibody is being produced in a non-human animal for research purposes. Owing to various side effects, including severe local reactions at sites of inoculation, FCA is not approved for use in humans and, therefore, will not comprise a component of an immunogenic composition or vaccine intended for administration to human subjects. FIA has been used in some vaccines administered to humans, but is less preferred in view of undesirable side effects compared with other approved alternatives, such as alum salts and monophosphoryl lipid A discussed below.

(2) Aluminum salts, such as alum salts, are particularly useful as adjuvant to stimulate an immune response to a polypeptide in vaccine compositions administered to humans. The term "alum" is commonly used to refer to a compound that is a combination of aluminum and potassium sulfate salt (such as $KAl(SO_4)_2.12H_2O$), or to an aluminum hydroxide. Although relatively weak when compared to other adjuvants, alum salts are the most commonly employed adjuvants used in vaccine compositions that are manufactured for administration to human subjects owing to the low incidence, if any, of adverse side effects. The term "alum" may sometimes also be used to refer to a broader group of aluminum and ammonia sulfate salts. Other aluminum salts that may be used to stimulate an immune response to a cold spot polypeptide, or immunogenic fragment thereof, present in an immunogenic composition or vaccine include, without limitation, aluminum hydroxide, aluminum phosphate, aluminum sulfate, hydrated alumina, alumina hydrate, alumina trihydrate (ATH), aluminum hydrate, aluminum trihydrate, alhydrogel, Superfos, Amphogel, aluminum (III) hydroxide, aluminum hydroxyphosphate sulfate, amorphous alumina, trihydrated alumina, and trihydroxyaluminum.

(3) Monophosphoryl lipid A, which, like alum, is an adjuvant that has been approved and used in vaccines manufactured for administration to human subjects.

(4) Oil-in-water emulsion formulations (with or without other specific immunostimulating agents such as muramyl peptides or bacterial cell wall components), such as, for example, (a) MF59 (International Publication No. WO 90/14837), containing 5% squalene, 0.5% Tween 80, and 0.5% Span 85 (optionally containing various amounts of MTP-PE (see below, although not required)) formulated into submicron particles using a microfluidizer such as Model 11 OY microfluidizer (Microfluidics, Newton, Mass.); (b) SAF, containing 10% squalene, 0.4% Tween 80, 5% pluronic-blocked polymer L121, and thr-MDP (see below) either microfluidized into a submicron emulsion or vortexed to generate a larger particle size emulsion; and (c) RIBI™ adjuvant system (RAS), (Corixa, Hamilton, Mont.) containing 2% squalene, 0.2% Tween 80, and one or more bacterial cell wall components from the group consisting of 3-0-deaylated monophosphoryl lipid A (MPL™) described in U.S. Pat. No. 4,912,094 (Corixa), trehalose dimycolate (TDM), and cell wall skeleton (CWS), preferably MPL+ CWS (Detox™).

(5) Muramyl peptides used as adjuvants may include, but are not limited to, N-acetyl-muramyl-L-threonyl-D-isoglutamine (thr-MDP), N-acetyl-normuramyl-L-alanine-2-(1'-2'dipalmitoyl-sn-glycero-3-hydroxyphosphoryloxy)-ethylamine (MTP-PE).

(6) Saponin adjuvants, such as Quil A or STIMULON™ QS-21 (Antigenics, Framingham, Mass., USA) (U.S. Pat. No. 5,057,540) may be used, or particles generated therefrom such as ISCOMs (immunostimulating complexes).

(7) Bacterial lipopolysaccharide (LPS) or synthetic lipid A analogs, such as aminoalkyl glucosamine phosphate compounds (AGP), or derivatives or analogs thereof (available from Corixa), as described in U.S. Pat. No. 6,113,918. One such AGP is 2-[(R)-3-tetradecanoyloxytetradecanoylamino] ethyl 2-deoxy-4-0-phosphono-3-0-[(R)-3-tetradecanoyloxytetradecanoyl]-2-[(R)-3-tetradecanoyloxytetradecanoylamino]-b-D-glucopyranoside, which is also known as 529 (formerly known as RC529), which is formulated as an aqueous form or as a stable emulsion.

(8) Synthetic polynucleotides, such as oligonucleotides containing CpG motif(s) as described, for example, in U.S. Pat. No. 6,207,646 may also be used in vaccine compositions of the invention.

(9) Cytokines, including, but not limited to, interleukins (for example, any one of IL-1, IL-2, IL-4, IL-5, IL-6, IL-7, IL-12, IL-15, IL-18, etc.), interferons (for example, gamma interferon), granulocyte macrophage colony stimulating factor (GM-CSP), macrophage colony stimulating factor (M-CSF), tumor necrosis factor (TNF), costimulatory molecules B7-1 and B7-2, may be used as adjuvants in immunogenic compositions and vaccines of the invention.

(10) Detoxified mutants of a bacterial ADP-ribosylating toxin such as a cholera toxin (CT) either in a wild-type or mutant form, for example, where the glutamic acid at amino acid position 29 is replaced by another amino acid, preferably a histidine, in accordance with International Publication No. WO 00/18434. See also WO 02/098368 and WO 02/098369), a pertussis toxin (PT), or an E. coli heat-labile toxin (LT), particularly LT-K63, LT-R72, CT-S109, PT-K9/G129 (see, e.g., WO 93/13202 and WO 92/19265).

Additional descriptions and details of the above adjuvants and others may be found in various pharmaceutical science and compositions handbooks and reviews available in the art. See, for example, in Petrovsky et al., *Immunol. Cell Biol.*, 82: 488-496 (2004), incorporated herein by reference.

It is understood that any immunogenic composition or vaccine comprising a cold spot polypeptide, or immunogenic fragment thereof, of the invention will require regulatory approval for non-experimental use of the composition in human subjects. Accordingly, an adjuvant that is not commonly employed in immunogenic compositions and vaccines, may nevertheless be approved when present as a component of a particular formulation that is granted regulatory approval for use in humans. A regulatory approval process typically assesses the benefit of a vaccine with respect to pneumococcal infection and disease against any risk or severity of untoward side effects.

Thus, any of a variety of pharmaceutically acceptable ingredients may be used in preparing an immunogenic composition comprising one or more *S. pneumonia* cold spot surface antigens, or immunogenic polypeptide fragments thereof, according to the invention. Preferably, such immunogenic compositions are prepared that are used to raise an immune response in a human that produces antibodies reactive with a majority of *S. pneumonia* capsular serotypes, more preferably with at least 80 different *S. pneumonia* serotypes, even more preferably with at least 90 different *S. pneumonia* serotypes, and still more preferably, with all or nearly all pneumococcal strains (currently, ~94 known serotypes).

The invention also provides methods of making immunogenic compositions described above. For example, a method of making an immunogenic composition for raising an immune response producing antibodies reactive against at least 80 different serotypes of *S. pneumoniae* comprises:

(1) selecting one or more cold spot surface antigens of *S. pneumoniae*, (2) isolating one or more polypeptide segments from an extracellular domain of the one or more cold spot surface antigens selected in step (1), and (3) formulating said one or more isolated polypeptide segments obtained in step (2) by admixing said isolated polypeptide with a pharmaceutically acceptable carrier, to produce an immunogenic composition for inoculating human subjects against *S. pneumonia* infection.

In an embodiment of the above method of making an immunogenic composition according to the invention, 1, 2, 3, 4, or 5 cold spot surface antigens are selected in step (1). In another embodiment of the above method, 1 or 2 cold spot surface antigens are selected. In a further embodiment of the method described above, 1 cold spot surface antigen is selected in step (1).

Preferably, in the above method of making an immunogenic composition according to the invention, the composition, when administered to a mammalian subject, is effective for raising an immune response producing antibodies reactive with at least 90 *S. pneumonia* serotypes, more preferably with at least 91 *S. pneumonia* serotypes, and even more preferably with at least 93 *S. pneumonia* serotypes.

In addition, in the above method of making an immunogenic composition according to the invention, the immunogenic composition may also include one or more adjuvants.

Uses of Cold Spot Polypeptide Compositions

As noted above, an immunogenic composition comprising an *S. pneumoniae* cold spot polypeptide, or immunogenic fragment thereof, described herein may be used to raise polyclonal or monoclonal antibodies for research or for passive immunity (immunotherapy).

For example, a polyclonal or monoclonal antibody raised against a cold spot polypeptide can be used to identify fragments of the cold spot polypeptide that are bound by the antibody ("antigenic" fragments). In a general, but non-limiting, example, standard deletion mutation protocols are available in the art and/or from commercial sources (for example, polymerase chain reaction (PCR) or nuclease deletion protocol) that can be used to generate a nested set of deletion mutated (truncated) sequences of a cold spot gene. Each of the corresponding encoded deletion mutant (truncated) polypeptides may then be expressed using a standard recombinant expression system (for example, but not limited to, a bacterial or yeast expression system) or by a cell-free in vitro transcription and translation system, which are readily available in the art and/or from commercial sources. Some deletion protocols also provide internal deletions of sequences for additional or closer analyses of encoded mutated polypeptides. Each of the expressed mutant polypeptides can then be assayed to determine whether or not it is bound by a polyclonal or monoclonal antibody raised to the cold spot protein using any of a variety of immuno-detection assays (for example, enzyme-linked immunosorbent assay (ELISA), immuno-dot blot, Western blot), which provide relatively rapid, multi-sample determination of antibody binding. Such mutant analysis to identify antigenic fragments of a cold spot polypeptide can also be carried out under contract with a commercial laboratory.

Other immunogenic compositions may be designed and used to determine efficacy as a potential vaccine composition to produce antibody that provides protective immunity against *S. pneumoniae* infection in a human or non-human animal subject or an animal model of pneumococcal infection. A "protective" immunity or "protective" immune response, when used in the context of a *S. pneumoniae* cold spot polypeptide or immunogenic fragment thereof, a composition comprising a *S. pneumoniae* cold spot polypeptide or immunogenic fragment thereof, or a method comprising administration of a *S. pneumoniae* cold spot polypeptide or immunogenic fragment thereof indicates that inoculation with such polypeptide, such composition, or according to such method results in a detectable immune response of sufficient magnitude (antibody titer) to provide a level of protection against *S. pneumoniae* infection in the inoculated human or non-human animal subject. Such protective immunity includes therapeutic and/or prophylactic effects that reduce the likelihood of *S. pneumoniae* infection or the likelihood of contracting one or more disorders resulting from such infection, as well as reducing the severity of the infection and/or a disorder resulting from such infection. As such, a protective immune response includes, for example, the ability to reduce bacterial load, ameliorate one or more disorders or symptoms associated with *S. pneumoniae* infection, and/or to delay the onset of disease progression resulting from *S. pneumoniae* infection. Diseases resulting from *S. pneumoniae* infection of particular interest with respect to this invention are pneumonia (lung infection), otitis media (middle ear infection), sinusitis (sinus infection), sepsis (bacteremia, bloodstream infection), and meningitis (infection of the meninges, which comprise three membranes covering the brain and spinal cord).

The level of protection can be assessed initially using animal models and subsequently phased clinical trials. The nature of an immune response may be measured, for example, by flow cytometry, development of antibodies, ELISA, opsonophagocytosis (OPA), or by measuring resistance to pathogen challenge in vivo. In a non-limiting example, to determine whether a protective immune response is induced by compositions of the present invention, immunized test animals can be challenged with *Streptococcus pneumoniae* and the growth and spread of the bacteria in the animals, survival of challenged animals, or change in health of the challenged animals may be measured over time. Such a study may also monitor progression of symptoms of any disease caused by pneumococcal infection in one or more tissues or organs.

As explained above, cold spot polypeptides encoded by *S. pneumoniae* cold spot genes are highly conserved across most if not all known capsular serotypes of *S. pneumoniae*. Therefore, a pharmaceutically acceptable immunogenic composition comprising a cold spot polypeptide, or an immunogenic fragment thereof, as described herein may be used as a vaccine that is administered to a human subject to elicit an immune response to the cold spot polypeptide or immunogenic fragment thereof, and thereby to any or all *S. pneumoniae* capsular serotypes that express the same highly conserved cold spot polypeptide or immunogenic fragment. Such a vaccine is particularly desirable because currently marketed vaccines are designed to elicit an immune response to only a limited number of the 94 or so known pneumococcal polysaccharide capsular serotypes. As just one example, the vaccine currently marketed as PREVNAR-13® (Wyeth LLC, marketed by Pfizer, New York, N.Y.) comprises 13 polysaccharide capsular antigens from 13 selected pneumococcal capsular serotypes and thus is formulated to elicit an immune response to infection by any of the 13 selected *S. pneumoniae* serotypes but none of the remaining 81 known *S. pneumoniae* capsular serotypes. In contrast, each cold spot polypeptide described herein is highly conserved and expressed across all or nearly all known *S. pneumoniae* capsular serotypes, and therefore an immune response elicited to a cold spot polypeptide, or immunogenic fragment thereof, provides an immune response (such as antibodies) directed to most if not all known serotypes of *S. pneumoniae*. Moreover, the emergence of a breakthrough escape mutant is significantly lower owing to the recombinantly quiescent (cold spot) origin of the gene encoding the cold spot polypeptide. It is expected that a vaccine composition comprising as few as two cold spot polypeptides or immunogenic fragments thereof would virtually eliminate the possibility of a breakthrough strain of *S. pneumoniae* emerging.

Accordingly, in a preferred embodiment, an immunogenic composition of the invention useful as a vaccine against pneumococcal infection comprises at least one *S. pneumoniae* cold spot polypeptide or immunogenic fragment thereof, as described herein; a pharmaceutically acceptable vehicle (such as PBS); and, as optionally desired, a pharmaceutically acceptable adjuvant (for example, an alum salt or another adjuvant described above). Based on the property of a vaccine composition of the invention comprising at least one *S. pneumoniae* cold spot polypeptide or immunogenic fragment thereof to elicit an immune response that produces antibodies to most if not all pneumococcal serotypes, a vaccine composition of the invention may also be referred to as a "capsular serotype-independent vaccine" or, alternatively, as a "universal *S. pneumoniae* vaccine".

Detection and Characterization of Antibodies Raised Against Cold Spot Polypeptides Antibodies raised to a *S. pneumoniae* cold spot polypeptide, or an immunogenic fragment thereof, may be detected using any of a variety of assays that are known in the art and/or that are commercially available. Such assays present a cold spot polypeptide or an antigenic fragment thereof that can be brought into contact with a sample that contains or is suspected of containing antibody raised to the cold spot polypeptide or an immunogenic fragment thereof. Such assay formats include, but are not limited to, immunoprecipitation, enzyme linked immunosorbent assay (ELISA), opsonophagocytosis (OPA), immuno-dot blot assay, Western (immuno) blotting, immuno-affinity chromatography, flow cytometry (FCM), and fluorescence-activated cell sorting (FACS). In such assays, antibody bound to the cold spot polypeptide or antigenic fragment thereof, forming an antibody-antigen complex, can be detected by any of a variety of detection systems available in the art. Such detection systems may include the use of a secondary antibody that will bind to the antibody raised against the cold spot polypeptide or fragment thereof. Such a secondary antibody may be conjugated or otherwise linked to a detectable label, such as, but not limited to, a radiolabel, a fluorescent label, biotin, or an enzyme that can generate a detectable signal when provided with its corresponding substrate. Examples of enzymes that may be conjugated to a secondary antibody in such detection systems include, but are not limited to, horseradish peroxidase, alkaline phosphatase, and luciferase. Other standard assays for detecting antibody or determining the titer of antibody in a sample are known to the skilled practitioner in the art.

Antibodies can be assessed for binding affinity and potency using various analytical ELISA formats or by detecting binding in real time using surface plasmon resonance (SPR) techniques using, for example, a BIACORE™ SPR detection instrument (GE Healthcare Bio-Sciences, Pittsburgh, Pa., USA). Such affinity assays may be especially useful in characterizing antibody used for research or passive immunity studies.

Additional embodiments and features of the invention will be apparent from the following non-limiting examples.

EXAMPLES

*Streptococcus Pneumoniae* Highly Conserved "Cold Spot" Proteins Useful in Pneumococcal Vaccines By analysis of 50-kb regions upstream and downstream of the four rrn operons of all available *S. pneumoniae* genomes on the NCBI website as outlined supra, recombinationally quiescent or "cold spot" genes were identified that encode polypeptides (cold spot polypeptides) of extremely high retention from strain to strain and extremely low variability in sequence. Among such cold spots in the *S. pneumoniae* genome, it was hypothesized that proteins would be encoded that would be valuable as vaccine antigens. Using subcellular protein localization algorithms (Gpos-mPloc, described by Shen et al., *Protein Pept. Lett.*, 16(12): 1478-1484 (2009); PSORTdb described by Yu et al., *Nucleic Acids Res.*, 39 (database issue): D241-D244 (2011); and LocateP described by Zhou et al., *BMC Bioinfonnatics*, 9(173): 17 pages. (2008)), 104 cold spot genes, encoding putative expressed proteins, were identified from the rrn flanking regions. At the time of the analysis, 231 fully sequenced *S. pneumoniae* genomes were available for comparison. Cold spot genes that were in-common (present) in all strains and showed very low sequence variability among all 231 sequenced genomes reported in the NCBI pneumococcal database were of particular interest, as these two characteristics gave an initial indication that such phenotypes might be essential for survival of the cell, since *S. pneumoniae* genomes deleting or significantly mutating the protein evidently did not survive to propagate.

A search of the scientific literature was conducted on each of the 104 genes and their predicted expression products, and on cognate proteins of other organisms, to determine likely biological properties and functions of the encoded surface proteins. From the literature survey, ~79 genes were selected as likely encoding surface proteins and ranked in order of most likely to be essential to cell survival. The top 21 surface proteins from the 79 identified surface protein genes located in the flanking regions of the *S. pneumoniae* rrn operons were further analyzed for universal presence in the 231 known, fully sequenced *S. pneumoniae* genomes and to determine the exact degree of sequence invariability across the population of different *S. pneumoniae* strains. Sequence information and amino acid sequence homology for the 21 cold spot surface proteins and their allelic variants is shown in Tables 1A and 1B, above. Identification of 58 additional surface proteins from the cold spot flanking regions adjacent the rrn operons of *S. pneumoniae* is made in Table 2, below.

The 58 genes in the table below are listed by consecutive map positions, located immediately up-stream and down-stream of the 4 rrn operons (rrnA, rrnB, rrnC, rrnD) of the genomically sequenced *S. pneumoniae* isolate TIGR4. The data in Table 2 were acquired by examination of at least 123 pneumococcal isolates. The data presented in Tables 1A and 1B (supra) are thus more complete, representing comparison of all 231 fully sequenced pneumococcal genomes (as well as additional sequences from incomplete genomes) available at the time. In Table 2, below, in addition to the mapped position for the 58 additional surface proteins identified, the mapped position in the TIGR4 *S. pneumoniae* genome of the four rrn operons is also given, to show the location of the cold spot genes in relation to the positions of the rrn operons.

TABLE 2

Additional Surface Protein-Encoding Genes from rrn Operon-Flanking Regions of *S. pneumoniae*

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| SP_2207 | ComF, putative competence protein; KEGG pathway Type II secretion system | 100% | >99% | 2127745-2128407 (SEQ ID NO: 274) | 220 |
| SP_2216 | PcsB, putative murein hydrolase or protein required for cell wall separation | 98% | >99% | 2135267-2136445 (SEQ ID NO: 275) | 392 |
| SP_2223 | Hypothetical protein; Function unknown. | 100% | >99% | 2140901-2141731 (SEQ ID NO: 276) | 276 |

TABLE 2-continued

Additional Surface Protein-Encoding Genes from
rrn Operon-Flanking Regions of *S. pneumoniae*

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| SP_2226 | Hypothetical protein; Function unknown | 100% | >99% | 2144453-2144821 (SEQ ID NO: 277) | 122 |
| SP_0005 | PTH, peptidyl-tRNA hydrolase | 100% | >99% | 4382-4951 (SEQ ID NO: 278) | 189 |
| SP_0007 | SS4Dom | 100% | >99% | 8519-8785 (SEQ ID NO: 279) | 88 |
| SP_0008 | Hypothetical protein, PY-triad | 100% | >99% | 8778-9146 (SEQ ID NO: 280) | 122 |
| SP_0010 | Hypothetical protein, PY-triad | 100% | >99% | 9266-10534 (SEQ ID NO: 281) | 422 |
| rrnA operon 5S-23S-16S genes | 5S, 23S and 16S rrn structural RNA molecules | 100% | | 15344-20236 (SEQ ID NO: 282) | |
| SP_0016 | IS630-Spn1, transposase Orf2 Transposase and inactivated derivatives | 100% | >99% | 20929-21267 (SEQ ID NO: 283) | 112 |
| SP_0020 | cytidine/deoxycytidylate deaminase family protein | 100% | >99% | 24319-24786 (SEQ ID NO: 284) | 155 |
| SP_0021 | Dut, deoxyuridine 5'-triphosphate nucleotidohydrolase | 100% | >99% | 24973-25416 (SEQ ID NO: 285) | 147 |
| SP_0024 | conserved hypothetical protein, Carbonic anhydrase | 100% | >99% | 27381-27878 (SEQ ID NO: 286) | 165 |
| SP_0030 | ccs16, competence-induced protein Ccs16; | 100% | >99% | 30563-30889 (SEQ ID NO: 287) | 108 |
| SP_0037 | plsX, fatty acid/phospholipid synthesis protein; Lipid transport and metabolism | 98% | >99% | 38101-39093 (SEQ ID NO: 288) | 330 |
| SP_0041 | blpU, bacteriocin, PY-triad | 100% | >97% | 39871-40101 (SEQ ID NO: 289) | 76 |
| SP_0046 | purF, amidophospho-ribosyl transferase; Nucleotide transport and metabolism. | 100% | >97% | 49228-50670 (SEQ ID NO: 290) | 480 |
| SP_0048 | purN, phosphoribosyl glycinamide formyltransferase; Nucleotide transport and metabolism: | 98% | >99% | 51908-52453 (SEQ ID NO: 291) | 181 |
| SP_0050 | purH, bifunctional phosphoribosyl aminoimidazole-carboxamide formyl transferase/IMP cyclohydrolase; Purine metabolism | 100% | >99% | 53071-54618 (SEQ ID NO: 292) | 515 |

TABLE 2-continued

Additional Surface Protein-Encoding Genes from
rrn Operon-Flanking Regions of S. pneumoniae

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| SP_0053 | purE, phosphoribosyl aminoimidazole carboxylase catalytic subunit; Catalyzes a step in the de novo purine nucleotide biosynthetic pathway | 100% | >99% | 56405-56893 (SEQ ID NO: 293) | 162 |
| SP_0057 | PY-triad, Beta-N-acetylhexosaminidase; identified by match to PFAM protein family HMM PF00746 | 98% | >98% | 59624-63562 (SEQ ID NO: 294) | 1,312 |
| SP_1732 | StkP, serine/threonine protein kinase; | 100% | >98% | 1634699-1636678 (SEQ ID NO: 295) | 659 |
| SP_1793 | hypothetical protein; spoU rRNA methylase family | 63% | >95% | 1708735-1709310 (SEQ ID NO: 296) | 191 |
| SP_1847 | xpt, xanthine phosphoribosyl transferase; Adenine/guanine phosphoribosyl transferases and related PRPP-binding proteins; Nucleotide transport and metabolism | 100% | >98% | 1755277-1755858 (SEQ ID NO: 297) | 193 |
| SP_1850 | dpnC, type II restriction endonuclease DpnI; Recognizes the double-stranded and methylated sequence G(Me)ATC and cleaves after A-2; Endonucleolytic cleavage of DNA | 100% | >99% | 1757628-1758392 (SEQ ID NO: 298) | 254 |
| SP_1855 | alcohol dehydrogenase, zinc-containing; threonine dehydrogenase and related Zn-dependent dehydrogenases; Amino acid transport and metabolism | 100% | >99% | 1762944-1763981 (SEQ ID NO: 299) | 345 |
| SP_1865 | pepA, glutamyl-aminopeptidase; cellulase M and related proteins; Acting on peptide bonds; Carbohydrate transport and metabolism | 100% | >99% | 1771923-1772987 (SEQ ID NO: 300) | 354 |
| SP_1897 | sugar ABC transporter substrate-binding protein, PY-triad | 98% | >99% | 1803124-1804383 (SEQ ID NO: 301) | 419 |
| rrnD operon 5S-23S-16S genes | 5S, 23S and 16S rrn structural RNA molecules | 100% | | 1810171-1815064 (SEQ ID NO: 302) | |
| SP_1911 | Thioredoxin, putative; similar to SP: P29449 PID: 20047; identified by sequence similarity | 100% | >96% | 1824358-1824675 (SEQ ID NO: 303) | 105 |

TABLE 2-continued

Additional Surface Protein-Encoding Genes from
rrn Operon-Flanking Regions of *S. pneumoniae*

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| SP_1912 | Hypothetical protein | 100% | >96% | 1824672-1824971 (SEQ ID NO: 304) | 99 |
| SP_1923 | ply, Pneumolysin; identified by match to PFAM protein family HMM PF01289; | 100% | >99% | 1831896-1833311 (SEQ ID NO: 305) | 471 |
| SP_1937 | lytA, Autolysin; identified by match to PFAM protein family HMM PF015100 acetylmuramoyl-L-alanine amidase, phage origin | 100% | >98% | 1840405-1841361 (SEQ ID NO: 306) | 318 |
| SP_1947 | Hypothetical protein | 91% | >92% | 1850094-1850264 (SEQ ID NO: 307) | 56 |
| SP_1948 | Hypothetical protein; similar to PID: 559859; identified by sequence similarity | 100% | >99% | 1850367-1850591 (SEQ ID NO: 308) | 74 |
| SP_1949 | Hypothetical protein | 100% | >99% | 1850598-1850786 (SEQ ID NO: 309) | 62 |
| SP_1954 | serine protease subtilase family protein | 99% | >99% | 1857994-1859397 (SEQ ID NO: 310) | 467 |
| SP_1955 | Hypothetical protein | 95% | >99% | 1859412-1859723 (SEQ ID NO: 311) | 103 |
| SP_1980 | cbf1, cmp-binding factor1; Predicted HD-superfamily hydrolase | 100% | >99% | 1884257-1885183 (SEQ ID NO: 312) | 308 |
| SP_1990 | Primase-related protein; topoisomerase primase (TOPRIM) nucleotidyl transferase/hydrolase domain found in Ribonuclease M5 | 100% | >99% | 1893835-1894395 (SEQ ID NO: 313) | 186 |
| SP_1991 | Hydrolase; DNase TatD; TatD like proteins | 100% | >99% | 1894395-1895168 (SEQ ID NO: 314) | 257 |
| SP_1994 | alaT, Aminotransferase AlaT (alanine aminotransferase); Aspartate/tyrosine/ aromatic aminotransferase; Transferase activity, transferring nitrogenous groups | 100% | >99% | 1896929-1898143 (SEQ ID NO: 315) | 404 |
| SP_1997 | Cof family protein; Hydrolyse activity (catalyzing hydrolysis of various bonds, e.g., C—O, C—N, C—C, phosphoric anhydride bonds, etc.) | 98% | >98% | 1899242-1900630 (SEQ ID NO: 316) | 462 |

TABLE 2-continued

Additional Surface Protein-Encoding Genes from
rrn Operon-Flanking Regions of *S. pneumoniae*

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| rrnC operon 5S-23S-16S genes | 5S, 23S and 16S rrn structural RNA molecules | | | 1908828-1913721 (SEQ ID NO: 317) | |
| SP_2010 | pbp2A, Penicillin-binding protein 2A (penicillin-binding protein, 1A family); Membrane carboxypeptidase; Cell wall/membrane/envelope biogenesis; Biosynthesis and degradation of murein sacculus and peptidoglycan | 100% | >99% | 1915717-1917912 (SEQ ID NO: 318) | 731 |
| SP_2014 | IS630-Spn1, transposase Orf2; DNA replication, recombination, and repair | Not Determined | Not Determined | 1921149-1921487 (SEQ ID NO: 319) | 112 |
| SP_2021 | Glycosyl hydrolase, family 1; Beta-glucosidase/6-phospho-beta-glucosidase/beta-galactosidase; Carbohydrate transport and metabolism | Not Determined | Not Determined | 1926449-1927858 (SEQ ID NO: 320) | 469 |
| SP_2027 | Hypothetical protein; COG4642, Uncharacterized protein conserved in bacteria (Function unknown) | Not Determined | Not Determined | 1933726-1934136 (SEQ ID NO: 321) | 136 |
| SP_2030 | Tkt, Transketolase; carbohydrate transport and metabolism; catalyzes the formation of ribose 5-phosphate and xylulose 5-phosphate from sedoheptulose 7-phosphate and glyceraldehyde 3-phosphate | Not Determined | Not Determined | 1935028-1937004 (SEQ ID NO: 322) | 658 |
| SP_2042 | rnpA, Ribonuclease P; protein component of RNaseP which catalyzes the removal of the 5'-leader sequence from pre-tRNA to produce the mature 5'terminus | Not Determined | Not Determined | 1947360-1947731 (SEQ ID NO: 323) | 123 |
| SP_2051 | cglC, competence protein CglC; similar to GP: 3211750; identified by sequence similarity | Not Determined | Not Determined | 1952343-1952669 (SEQ ID NO: 324) | 108 |
| SP_2055 | Alcohol dehydrogenase, zinc-containing; amino acid transport and metabolism | Not Determined | Not Determined | 1955168-1956226 (SEQ ID NO: 325) | 352 |

TABLE 2-continued

Additional Surface Protein-Encoding Genes from
rrn Operon-Flanking Regions of *S. pneumoniae*

| GenBank Designation in TIGR4 Genomic Sequence | Encoded Protein and Function (if known) | Gene Presence across ≥123 genomes | % Sequence Homology | mapped position in TIGR4 genome, including stop codon (SEQ ID NO:) | protein length (aa) |
|---|---|---|---|---|---|
| SP_2056 | nagA, N-acetylglucosamine-6-phosphate deacetylase; Hydrolase activity acting on carbon-nitrogen bonds other than peptide bonds | Not Determined | Not Determined | 1956389-1957540 (SEQ ID NO: 326) | 383 |
| SP_2057 | Hypothetical protein; Predicted acyltransferase | Not Determined | Not Determined | 1957693-1959510 (SEQ ID NO: 327) | 605 |
| SP_2063 | LysM domain-containing protein; Lysin domain, found in a variety of enzymes involved in bacterial cell wall degradation | Not Determined | Not Determined | 1963634-1964746 (SEQ ID NO: 328) | 370 |
| SP_2064 | HAD superfamily hydrolase, haloacid dehalogenase-like family; identified by match to PFAM protein family HMM PF00702 | Not Determined | Not Determined | 1964912-1965532 (SEQ ID NO: 329) | 206 |
| SP_2066 | thrC, Threonine synthase; catalyzes formation of L-threonine from O-phospho-L-homoserine; Amino acid transport and metabolism | Not Determined | Not Determined | 1966877-1968361 (SEQ ID NO: 330) | 494 |
| rrnB operon 5S-23S-16S genes | 5S, 23S and 16S rrn structural RNA molecules | | | 1970844-1975734 (SEQ ID NO: 331) | |
| SP_2093 | hypothetical protein | Not Determined | Not Determined | 2001118-2002086 (SEQ ID NO: 332) | 322 |
| SP_2097 | 2,3,4,5-tetrahydro-pyridine-2-carboxylate N-succinyltransferase, putative; Amino acid transport and metabolism | Not Determined | Not Determined | 2004797-2005495 (SEQ ID NO: 333) | 232 |
| SP_2105 | Hypothetical protein | Not Determined | Not Determined | 2014784-2015356 (SEQ ID NO: 334) | 190 |
| SP_2106 | malP, glycogen phosphorylase family protein; Glucan phosphorylase; Carbohydrate transport and metabolism | Not Determined | Not Determined | 2016399-2018657 (SEQ ID NO: 335) | 752 |

To determine that the cold spot genes selected were in-common to all *S. pneumoniae* strains, genomic preparations immobilized on Zeta-Probe nylon membranes (Bio-Rad Laboratories, Inc.) were probed with a radiolabeled probe derived from the coding sequence for each of the 21 selected cold spot genes. In this way, it was determined that each of the selected cold spot genes was universally present across the inventor's laboratory collection of 2,500 phylogenically organized *S. pneumoniae* isolates. This is significant, because all protein-based vaccine candidates offered thus far have proved to be non-universal across all strains or have proved to be highly variable in sequence when multiple strains are considered. This leads to failure of such vaccines to address a significant number of *S. pneumoniae* strains or to allow "breakthrough" of strains in which an antigen which a candidate vaccine targets avoids the immune response induced by the original vaccine. See, e.g., Navarro-Torné et al., *Emerging Infectious Diseases*, 21(3):417-425 (2015).

Next, amino acid sequences of the predicted expression products of the surface protein genes were analyzed for sequence homology. The reference population of genomic sequences for this work was the 231 fully sequenced *S. pneumoniae* genomes available in the NCBI GenBank database at the time. For some proteins, alleles from additional strains for which the entire genome had not been fully sequenced but which were nonetheless available from the GenBank database were also analyzed. Amino acid sequences for each of the 21 proteins in each of the 231+ full or partial genomes were aligned and the degree of variability in sequence was determined. For each protein, a predominant sequence appeared, in which the amino acid sequence was the same across a majority of the strains considered, followed by allelic variants of varying numbers. The allelic variants differed from the predominant sequence by from one amino acid switch to as many as 23 amino acid sequence variations along the full protein sequence, for the 21 proteins studied. The number of alleles varied across the 21 cold spot genes studied from 1 to 34.

To quantitate the degree of sequence variability, the percent average amino acid sequence pairwise homology was determined for each cold spot polypeptide, according to the formula:

$$\frac{(100\% \times n) + (x\ \% \times n1) + (x\ \% \times n2) + \ldots (x\ \% \times nI)}{\text{(total number of sequences compared)}}$$

where: x % is the percent sequence identity in comparison to the predominant aa sequence;

n is the number of strains having the most prevalent (predominant) amino acid sequence;

n1 is the number of allelic variants of the next most prevalent amino acid sequence, after n;

n2 is the number of allelic variants of the next most prevalent amino acid sequence, after n1;

nI is the number of allelic variants of the least prevalent allelic variant sequence, where I is the total number of allelic variants in the population of amino acid sequences considered.

Accordingly, by way of example, a *S. pneumoniae* surface protein of 450 amino acids, having 65 allelic variants, where each of the variants has two amino acid differences from the predominant sequence, and where 231 genomic sequences were compared, would have an average amino acid sequence pairwise homology of over 99.87%, calculated as: [(100%× 166)+(448/450×100%×65)]÷231=[16600%+6471.11%]÷231=23071.11%÷231=99.875% average amino acid sequence pairwise homology.

It will be appreciated that the average amino acid sequence pairwise homology value will be affected by the total number of sequences compared, and therefore the question arises how many sequences must be compared before the pairwise homology number is accurately representative of the variability of the amino acid sequence throughout the universe of *S. pneumoniae* strains. Because the amino acid sequences encoded by cold spot genes are extremely invariant, the number of sequences that must be compared before a sequence homology value is obtained that is representative of the diversity of the entire population of *S. pneumoniae* strains is much lower than for a protein that shows more sequence variability across the population. To illustrate this, non-linear regression analysis was performed, plotting the cumulative number of allelic variants against the cumulative number of isolates considered for three cold spot polypeptides, i.e., GBSP23 (SP_2239), GBSP3 (SP_2218), and GBSP6 (SP_2217), in comparison with another well-known *S. pneumoniae* surface protein, PspA (SP_0117), which is much more variable across the population of *S. pneumoniae* strains. The comparative plot is shown in FIG. 1. The additional plot shown in FIG. 1, for SP_1872, was also for a cold spot polypeptide, but one having a lesser amino acid sequence pairwise homology (99.19%), and that protein was not extensively studied at this time. From this analysis, it can be seen that for the cold spot genes, the rate of diversification levels off well under 200 isolates, meaning that the results of sequence comparisons reported herein of 231 fully sequenced genomes (plus additional instances of individual genes from incomplete genomes) is representative of the diversity of the universe of *S. pneumoniae* strains. In contrast, referring in FIG. 1 to the curve for PspA, the rate of diversification has not leveled off on this plot at the limit of 300 compared isolates, meaning that many more isolates (than 300) would need to be compared before an accurate analysis of sequence diversity was obtained. This is important, since the number of known and fully sequenced genomes of *S. pneumoniae* has continued to grow, but calculations of relative constants, such as percentage amino acid sequence homology, will be expected not to vary significantly for relatively invariant cold spot genes, if at least about 150 or more separate strains are analyzed. Accordingly, in order to determine a percentage average amino acid pairwise sequence homology for a given coding sequence, the practitioner may compare 150 allelic sequences, or, e.g., 200, 400, 1000, 2000 or more allelic sequences, and the calculated sequence homology value will be expected to be essentially the same.

From the 21 cold spot surface polypeptides analyzed for essential function, sequence homology, and universal presence in the species, six polypeptides were further analyzed for suitability as vaccine candidates, as detailed below. Similar procedures can be applied to the other cold spot polypeptides determined to be surface-expressed in *S. pneumoniae*, to be in-common across all strains, and to have very high (99% or more) average amino acid sequence pairwise homology among isolates to confirm their utility as immunogens.

GenScript (Piscataway, N.J. (US)) was contracted to express and raise polyclonal antiserum against six selected cold spot surface polypeptides. Predominant coding sequence information for the proteins GBSP3 (SEQ ID NO:1), GBSP14 (SEQ ID NO:2), GBSP15 (SEQ ID NO:3), GBSP22 (SEQ ID NO:4), GBSP23 (SEQ ID NO:5), and GBSP24 (SEQ ID NO:6) set forth in Table 1A, above, was analyzed to predict such features as expressed amino acid sequence, antigenic index, hydrophilicity, solvent accessibility, flexible regions, coil/sheet/helical regions, and a breakdown of extracellular, transmembrane, and cytoplasmic domains along the length of the protein. For each of the six proposed cold spot polypeptides selected, a structural gene for expression of the largest extracellular segment was constructed, inserted into an expression vector, and expressed in E. coli. Purification of hexaHis- or octaHis-tagged polypeptides via $Ni^{++}$ affinity chromatography was performed prior to enzymatic elimination of the His tag. The portion of each polypeptide expressed and purified is presented in Table 3:

and 10-50 mg of affinity-purified rabbit polyclonal antibodies (ELISA titer of 1:32,000), were provided for further experiments. For control purposes, pre-inoculation rabbit serum was also supplied. The rabbit antisera were first tested using a pneumococcal whole cell ELISA (WCE) assay. Briefly, S. pneumoniae cells were immobilized in the wells of microtiter plates, antiserum at 1:10 dilution from the cold spot polypeptide immunizations were separately added to wells and incubated with the cells. A radiolabeled reporter anti-rabbit IgG antibody was used for detection of bound antiserum. Control wells received pre-immune serum for contrast with the test wells.

All of the cold spot polypeptides showed elicitation of antiserum that recognized the native surface antigens of

TABLE 3

Extracellular Portions of Cold Spot Surface Proteins for Immunogenicity Studies

| S. pneumoniae Surface Protein source of extracellular fragment expressed (SEQ ID for protein fragment) | Amino Acid Sequence of the Portion of the S. pneumoniae Surface Protein Expressed |
|---|---|
| GBSP3 (SEQ ID NO: 336) | RVVQKPFQWF DSVKSDLAHL TRTYNENESL KKQLYQLEVK SNEVESLKTE NEQLRQLLDM KSKLQATKTL AADVIMRSPV SWKQELTLDA GRSKGASENM LAIANGGLIG SVSKVEENST IVNLLTNTEN ADKISVKIQH GSTTIYGIII GYDKENDVLK ISQLNSNSDI SAGDKVTTGG LGNFNVADIP VGEVVATTHS TDYLTREVTV KLSADTHNVD VIELVGNS |
| GBSP14 (SEQ ID NO: 337) | LILEVTAVPV FSPTQSVEAV LVLLYDLTTI RTYEKLNLAF VSNASHELRT PVTSIKGFAE TIKGMSAEEE ALKDDFLDII YKESLRLEHI VEHLLTLSKA QQMPIQWTTL SLAEFVQDLT QSLQPQLKKK DLQLKVQVPD DVTLVSDSQL LSQILLNLLS NAIRYTEQGG KIEVKTQKVN EGIKISVSDT GIGISQLEQD RIFERFYRVN KGRSRQTGGT GLGLAIVKEL SQLLGGQVTV TSQLGRGSCF TIFLPNQSFA QD |
| GBSP15 (SEQ ID NO: 338) | QKNRQEEAKI LQKEEVLRVA KMALQTGQNQ VSINGVEIQV FSSEKGLEVY HGSEQLLAIK EP |
| GBSP22 (SEQ ID NO: 339) | SLASAVEALL APLKRVKVPV HEIGLMLSMS LRFVPTLMDD TTRIMNAQKA RGVDFGEGSI VQKVKAMIPI LIPLFATSLK RADSLAIAME ARGYQGGKGR SQYRQLKWTL KD |
| GBSP23 (SEQ ID NO: 340) | TQKSSVNNSN NNSTITQTAY KNENSTTQAV NKVKDAVVSV ITYSANRQNS VFGNDDTDTD SQRISSEGSG VIYKKNDKEA YIVTNNHVIN GASKVDIRLS DGTKVPGEIV GADTFSDIAV VKISSEKVTT VAEFGDSSKL TVGETAIAIG SPLGSEYANT VTQGIVSSLN RNVSLKSEDG QAISTKAIQT DTAINPGNSG GPLINIQGQV IGITSSKIAT NGGTSVEGLG FAIPANDAIN IIEQLEKNGK VTRPALGIQM VNLSNVSTSD IRRLNIPSNV TSGVVVRSVQ SNMPANGHLE KYDVITKVDD KEIASSTDLQ SALYNHSIGD TIKITYYRNG KEETTSIKLN KSSGDLES |
| GBSP24 (SEQ ID NO: 341) | NSHKVQMEKE IALKQKKFEQ KHLQNYTDEI VGLYNEIRGF RHDYAGMLVS MQMAIDSGNL QEIDRIYNEV LVKANHKLRS DKYTYFDLNN IEDSALRSLV AQSIVYARNN GVEFTLEVKD TITKLPIELL DLVRIMSVLL NNAVEGSADS YKKQMEVAVI KMETETVIVI QNSCKMTMTP SGDLFALGFS TKGRNRGVGL NNVKELLDKY NNIILETEME GSTFRQIIRF KREFE |

Six of the purified cold spot polypeptide candidate antigens were used to inoculate rabbits 2-3 times over 6-8 weeks for production of polyclonal antiserum. Rabbits were selected for immunization to elicit a greater volume of antiserum than would have been produced in, e.g., laboratory mice. About 3 mg of each polypeptide at >85% purity, pneumococcal cells from ten different S. pneumoniae serotypes. The selected serotypes corresponded to ten of the thirteen serotypes addressed by the commercial PREVNAR-13® vaccine. Table 4 shows the fold increase range in colorimetric response of the polyclonal antiserum compared with the signal produced by pre-immune serum.

TABLE 4

Vaccine Candidate Antigenicity Results
Based on Whole Cell ELISA (WCE)

| Cold Spot Surface Antigen Tested | SEQ ID NO: | Range of Increase in Colorimetric Intensity Across 10 Pneumococcal Strain Serotypes, from Comparison of Pre-immune vs. Post-immune Antiserum |
|---|---|---|
| GBSP3 | 1 | 15-20 |
| GBSP14 | 2 | 20-30 |
| GBSP15 | 3 | 10-25 |
| GBSP22 | 4 | 20-30 |
| GBSP23 | 5 | 40-220 |
| GBSP24 | 6 | 20-70 |

Whole cell ELISA results confirmed that the cold spot polypeptides are antigenic, presenting antibody-recognizable targets on the surface of pneumococcal cells. The fact that the tested polyclonal antiserum included anti-cold spot polypeptide IgG antibodies (bound by the reporter antibody) indicates that the surface antigens are immunogenic, eliciting a T cell-dependent antibody response.

Flow cytometry was also performed to evaluate surface antigenicity, using 1:100 dilution of antisera. The relevance of the six cold spot polypeptides was also confirmed by testing with pooled healthy human antiserum and rabbit antiserum from whole cell vaccinations.

Evaluation of Cold Spot Polypeptide Antisera for the Ability to Elicit Protection In Vivo The antisera raised by the six selected cold spot polypeptides were next tested in a passive immunity model described in Briles et al., *J. Infect. Dis.*, 182(6):1694-1701 (2000). Pre-immune and post-immune antiserum from the cold spot polypeptide immunizations was administered intraperitoneally to groups of CBA/N mice at 1:25, 1:100, 1:400, or 1:1600 dilutions one hour before intravenous challenge with a mouse-virulent strain of *S. pneumoniae*. Ringer's injection solution was used as a negative control; a known protective anti-PspA monoclonal antibody for the challenge strain was used as a positive control. Challenged mice were observed for changes in health and time to moribund. Time to moribund is determined by monitoring the mice every 6 hours post-challenge for signs of disease, hunched back, ruffled fur, irritability, lack of mobility, or failure to respond to touch. As soon as any of these symptoms are observed the surface temperature, determined with a scanning thermometer, is checked every 6 hours. When the surface temperature falls to 25° C., mice are considered moribund and are scored as such, euthanized with $CO_2$ narcosis and cervical dislocation. In some cases, heart blood, collected after death, was plated to verify bacteremia with pneumococci. The results indicated that three of the cold spot immunogens (GBSP14, GBSP15, and GBSP23) were at least partially protective, in that time to death was extended with GBSP15 and "statistically protective" with GBSP23. Mice receiving GBSP14 antiserum exhibited passive immunity protection equivalent to the PspA monoclonal antibody positive control.

Active immunization experiments are under way using 10 pg of antigen in a 10 pL volume of Pierce Alum Imject adjuvant, administered subcutaneously three times at 2-week intervals. It is expected that this immunization will result in protective immunity, demonstrated, e.g., by intravenous challenge with active *S. pneumoniae* bacteria.

Results from the battery of tests performed using purified antigen and rabbit antisera are shown in Table 5 below.

TABLE 5

Test Results for Different Vaccine Candidates

| Candidate Designation | Whole Cell ELISA | Flow cytometry | Passive protection assay | Human Pooled Serum | IgG | Whole Cell Vaccine |
|---|---|---|---|---|---|---|
| GBSP3 | ++ | − | − | +++ | +++ | ++ |
| GBSP14 | ++ | − | +++ | +++ | +++ | ++ |
| GBSP15 | ++ | + | + | +++ | +++ | ++ |
| GBSP22 | − | ++ | − | +++ | +++ | ++ |
| GBSP23 | − | − | +++ | +++ | +++ | ++ |
| GBSP24 | − | − | − | +++ | +++ | ++ |

"−" negative; "+" slightly positive; "++"positive; "+++", strongly positive.

The results from the assay with healthy human serum shows that the general population has been exposed to *S. pneumoniae* and has generated a background anti-pneumococcal response even in the absence of pathogenic infection. Significantly, the assay reported here indicates that the six selected cold spot surface antigens were among the host of pneumococcal antigens recognized by the pooled serum.

All of the studied *S. pneumoniae* cold spot surface antigens were immunogenic in at least some of the plural tests. Differing results from test to test may be attributable to such factors as amount of immunogen utilized, purity of the inoculum, number of boosts, or factors pertaining to the target antigen itself such as differences in biological function, differential gene expression, or the effect of antibody complexation at the cell surface as part of the assay. For example, a very abundant protein on the cell surface might outperform a less abundant protein in the whole cell ELISA, e.g., by presenting many more antibody targets on the cell surface. In contrast, a cell surface antigen which, even in low abundance, led to cell death when complexed with antibody would make the protein a high performing antigen in the passive immunity assay.

From the foregoing results, it is seen that this invention provides a family of immunogenic *S. pneumoniae* surface antigens that will be useful for immunization of subjects, including humans, for eliciting an anti-*S. pneumoniae* antibody response. Optimization of dosing and boosting schedules according to well known practices will result in immunogenic compositions effective as vaccines for inducing protective immunity against *S. pneumoniae*. Moreover, because the surface antigens disclosed herein are in-common to all or nearly all strains of *S. pneumoniae*, and because they all exhibit a very high degree of sequence invariability, as expressed by percent amino acid sequence pairwise homology across at least 123 different *S. pneumoniae* strains, the antigens of the present invention are expected to provide universal immunogens, from which breakthrough will be extremely rare if not unknown over time.

The present invention provides a means for determining and selecting *S. pneumoniae* surface antigens that are universal vaccine candidates by virtue of their essentially universal presence across all *S. pneumoniae* genomes and their high degree of amino acid sequence conservation among *S. pneumoniae* strains. While the particular surface antigens identified herein fit the rigorous selection criteria for a universal *S. pneumoniae* vaccine, a few antigens have been identified previously using alternative techniques such as antigenomic screening which qualify them as potential vaccine candidates without determination of their universal presence across pneumococcal genomes or their level of sequence homology. See, e.g., Giefing et al., *J. Exp. Med.*, 205(1):117-131 (2008). In such instances where the present

SEQUENCE LISTING (341 sequences)

SEQ ID NO: 1 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 2 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 3 - protein, 86 aa, Streptococcus pneumoniae
MILLEAVVALAIFASIATLLLGQIQKNRQEEAKILQKEEVLRVAKMALQTGQNQVSINGVEIQVFSSEKGLEVYHGSEQLLAIKEP

SEQ ID NO: 4 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 5 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 6 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 7 - protein, 58 aa, Streptococcus pneumoniae
MRFIGDIFRLLKDTTWPTRKESWRDFRSIMEYTAFFVVIIYIFDQLIVSGLIRFINIF

SEQ ID NO: 8 - protein, 158 aa, Streptococcus pneumoniae
MKGVTNMTPEEMYLTERLDVQIAHFLKKSVQHRRRYKVLKITEIVAGFLIAVFCAIPMPGDRYRLISVALSSLGLLCEGIINLYNAKENWISYQKTAQLLEKEKFLYQCQTEKYAGKTKAFALFVKTCEGLISEEINQWESIQSKEVAASADAPVKKE

SEQ ID NO: 9 - protein, 435 aa, Streptococcus pneumoniae
MKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 10 - protein, 164 aa, Streptococcus pneumoniae
MRQLKRVGVFLLLPFFVLIDAHISQLLGSFFPHVHLASHFLFLFLLFETIEVSEYLYLVYCFVIGLVYDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 11 - protein, 271 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 12 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 13 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 14 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 15 - protein, 274 aa, Streptococcus pneumoniae
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 16 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 17 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 18 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 19 - protein, 285 aa, Streptococcus pneumoniae
MNYPKIDLKTIRQESKHFQADTPRLFLLYILPSMLVILSGFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 20 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 21 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKVTASEDGVLHLNPETSDSSMVAEGALLAQLYPSLEREGKAKLTAYLSSKYVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 22 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKVSQLNSNSDISAGDKVTTGGLGNFNVADIPVGEVVATTHSTDYLTREVTVKLSADTHNVDVIELVGNS

SEQ ID NO: 23 - protein, 272 aa, Streptococcus pneumoniae
MNRFKKSKYVIIVFVTVLLVSALLATTYSSTVVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 24 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVVDIPVGEVVATTHSTDYLTREVTVKLSADTHNVDVIELVGNS

SEQ ID NO: 25 - protein, 272 aa, Streptococcus pneumoniae
MNRFKKSKYVIIVFVTVLLVSALLATTYSSTIVTKLGDGISLVDRVVQKPFQWFDSVKSDLAHLTATYNENESLKKQIYQLEVKSNEAESLKTENEQLRQLLGMKSKLQATKTLAADVIMRSPVSWKQELTLDVGKSKGASENMLAIANGGLIGSVSKVEENSTIVNLLTNTENADKISVKIQHGTTTIYGIIVGYDKENDVLKISQLNSNSDISTGDKVTTGGLGNFNVVDIPVGEVVATTHSTDYLTREVTVKLSADTHNVDVIELVGNS

SEQ ID NO: 26 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGAFENMLAIANGGLIGSVSKVEENSTIVNLLTNTENADKISVKIQHGSTTIYGIIIGYDKENDVLKISQLNSNSDISAGDKVTTGGLGNFNVVDIPVGEVVATTHSTDYLTREVTVKLSADTHNVDVIELVGNS

SEQ ID NO: 27 - protein, 272 aa, Streptococcus pneumoniae
MNRFKKSKYVIIVFVTVLLVSALLATTYSSTIVTKLGDGISLVDRVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSITIYGIIIGYDKENDVLKISQLNSNSDISAGDKVTTGGLGNFNVVDIPVGEVVATTHSTDYLTREVTVKLSADTHNVDVIELVGNS

SEQ ID NO: 28 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 29 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSALKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 30 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAKYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 31 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSGLKTKVSQQDQQYKDLAETMEILLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 32 - protein, 443 aa, Streptococcus pneumoniae
MKRYLQFWLVNLSVSLILIAGMALTWISKGIGLFLLAFSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 33 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKGNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 34 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSALKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHSVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 35 - protein, 443 aa, Streptococcus pneumoniae
MKRYLQFWLVNLSVSLILIAGMALTWISKGIGLFLLALSLGLGGYWLFCLWKWEVAFKTLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 36 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHHLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 37 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLISDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 38 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAQYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRIYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 39 - protein, 443 aa, Streptococcus pneumoniae
MKRYLQFWLVNLSVSLILIAGMVLTWISKGIGLFLLALSLGQGGYWLFCLWKWEVAFETLHQPLLTSSEYFLEKGQEDLKSLAQYVSALKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 40 - protein, 443 aa, Streptococcus pneumoniae
MKRYLQFWLVNLSVSLILIAGMALTWISKGIGLFLLALSLGLGGYWLFCLWKWEVAFETLHQPLLTSSEYFLEKGQEDLKSLAKYVSGLKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTLIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 41 - protein, 443 aa, Streptococcus pneumoniae
MKRYLQFWLVNLSVSLILIAGMALTWISKGIGLFLLALSLGQGGYWLFCLWKWEVAFETLHQPLLTSSEYFLEKGQEDLKSLAQYVSALKTKVSQQDQQYKDLAETMEVLLSHLTMGTFLVSAQGQMLLSSRSLPHYFPDVDGDISSLDDLKRMDIRNLVHQAFDQKTRLKQEVSGFHEGDLILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNTIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 42 - protein, 86 aa, Streptococcus pneumoniae
MILLEAVVALAIFASIATLLLGQIQKNRQEEAKILQKEEVLRVAKMALQTGQNQVNINGVEIQVFSSEKGLEVYHGSEQLLAIKEP

SEQ ID NO: 43 - protein, 86 aa, Streptococcus pneumoniae
MILLEAVVALAIFASIATLLLGQIQKNRQEEAKILQKEEVLRVAKMALQTGQSQVSINGVEIQVFSSEKGLEVYHGSEQLLAIKEP

SEQ ID NO: 44 - protein, 86 aa, Streptococcus pneumoniae
VILLEAVVALAIFASIATLLLGQIQKNRQEEAKILQKEEVLRVAKMALQTGQNQVSINGVEIQVFSSEKGLEVYHGSEQLLAIKEP

SEQ ID NO: 45 - protein, 86 aa, Streptococcus pneumoniae
MILLEAVVALAIFASIAPLLLGQIQKNRQEEAKILQKEEVLRVAKMALQTGQNQVSINGVEIQVFSSEKGLEVYHGSEQLLAIKEP

SEQ ID NO: 46 - protein, 86 aa, Streptococcus pneumoniae
VILLEAVVALAIFASIATLLLGQIQKNRQEEAKILQKEEVLRVAKMALQTGQSQVSINGVEIQVFSSEKGLEVYHGSEQLLAIKEP

SEQ ID NO: 47 - protein, 86 aa, Streptococcus pneumoniae
VILLEAVVALAIFASIATLLLGQIQKNRQEEAKILQKEEVLRVAKMALQTGQNQNSINGVEIQVFSSEKGLEVYHGSEQLLAIKEP

SEQ ID NO: 48 - protein, 86 aa, Streptococcus pneumoniae
MILLEAVVALAIFASIATLLLGQIQKNRQEEAKILQKEEVLRVTKMALQTGQNQVNINGVEIQVFSSEKGLEVYHGSEQLLAIKEP

SEQ ID NO: 49 - protein, 86 aa, Streptococcus pneumoniae
MILLEAVVALAIFASIATLLLGQIQKNRQEEAKILQKEEVLRVAKMALQTGQNQVNINGVEIQVFSSEKGLAVYHGSEQLLAIKEP

SEQ ID NO: 50 - protein, 86 aa, Streptococcus pneumoniae
MILLEAVVALAIFASIATLLLGQIQKNRQEEAKILQKEEVLRVAKMALQTGQNQVNINGVEIQVFSSEKGLEVYHGSEQLLAIKEL

SEQ ID NO: 51 - protein, 86 aa, Streptococcus pneumoniae
MILLEAVVALAIFASIATLLLGQIQKNRQEEAKILQKEEVLRVAKMALQTGQNQININGVEIQVFSSEKGLEVYHGSEQLLAIKEP

SEQ ID NO: 52 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVYEIGLMLSMSLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 53 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRIQYRQLKWTLKDTLTILVILVLGCCLFFLKS

SEQ ID NO: 54 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKSMIPILIPLFATSLKRADSLAIAMEARGYQGGKGRSQYRQLKWTLKDTLTILVILVLGCCLFFLKS

SEQ ID NO: 55 - protein, 264 aa, Streptococcus pneumoniae
MDSMILGRYIPGDSIVHRLDPRSKLLAMMLLILIVFWANNPLTNLILFIATGIFIALSGVSLSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSISLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 56 - protein, 264 aa, Streptococcus pneumoniae
MDSMILGRYIPGDSIVHRLDPRSKLLAMMLLILIVFWANNPLTNLILFIATGIFIALSGVSFSFFIQGLKSMFFLIAFTTIFQLFFISNGNVLFEFSFVRITDYALQQAGIIFCRFVLIIFFSTLLTLTTMPLSLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRSQYRQLKWTLKDTLTILVILVLGCCLFFLKS

SEQ ID NO: 57 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVIVRSVQSNMPANGHLEKYDVITKVDDKEIASSTDLQSALYNHSIGDTIKITYYRNGKEETTSIKLNKSSGDLES

SEQ ID NO: 58 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 59 - protein, 393 aa, Streptococcus pneumoniae
MKHLKTFYKKSFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVIVRSVQSNMPANGHLEKYDVITKVDDKEIASSTDLQSALYNHSIGDTIKITYYRNGKEETTSIKLNKSSGDLES

SEQ ID NO: 60 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGKIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVIVRSVQSNMPANGHLEKYDVITKVDDKEIASSTDLQSALYNHSIGDTIKITYYRNGKEETTSIKLNKSSGDLES

SEQ ID NO: 61 - protein, 393 aa, Streptococcus pneumoniae
MKHLKTFYKKGFQLLVVIVISFFSGALGSFSIAQLTQKSSVSNSNNNSTITQTAYKNENSTTQAVNKVKDAVVSVITYSANRQNSVFGNDETDTDSQQISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNISTSDIRRLNIPSNVTSGVVVRSVQSNMPANGHLEKYDVITKVDDKEIASSTDLQSALYNHSIGDTIKITYYRNGKEETTSIKLDKSSGDLES

SEQ ID NO: 62 - protein, 393 aa, Streptococcus pneumoniae
MKHLKTFNKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVITSDIRRLNIPSNVTSGVIVRSVQSNMPANGHLEKYDVITKVDDKEIASSTDLPSALYNHIIGDTIKITYYRNGKEETTSIKLNKSSGDLES

SEQ ID NO: 63 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKKRKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 64 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDAAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 65 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKNGKVTRPVLGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 66 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLRSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVIVRSVQSNMPANGHLEKYDVITKVDDKEIASSTDLQSALYNHSIGDTIKITYYRNGKEETTSIKLNKSSGDLES

SEQ ID NO: 67 - protein, 393 aa, Streptococcus pneumoniae
MKHLKTFYKKWFQLLVVIVISFFSGALGSFSITQLTQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGNPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 68 - protein, 393 aa, Streptococcus pneumoniae
MKHLKTFYKKGFQLLVVIVISFFSGALGSFSIAQLTQKSSVSNSNNNSTITQTAYKNENSTTQAVNKVKDAVVSVITYSANRQNSVFGNDETDTDSQQISSEGSGVIYKKNDKEAYIVTNNHVINGASKVDIRLSDGTKVPGEIVGTDTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNISTSDIRRLNIPSNVTSGVVVRSVQSNMPANGHLEKYDVITKVDDKEIASSTDLQSALYNHSIGDTIKITYYRNGKEETTSIKLDKSSGDLES

SEQ ID NO: 69 - protein, 441 aa, Streptococcus pneumoniae
MDLLGFGTVIVHFLIISHSYRLICKGRINRKELYVFGAYTLLTEIVLEFSFYLLYLDKIGIERFLFPLGLYSYFRWMKQYERDRGLFLSLLLSLLYESTHNFLSVIFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 70 - protein, 441 aa, Streptococcus pneumoniae
MDLFGFGTVIVHLLIISHNYHLICKGQINRKELFVFGAYTLLTEIVFDFPLYILYLDGLGIAIFLFPLGLYSYFRWMKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFSLGFSTKGRNRGVGLNNVKELLDKYNNIILETEMEGSTFRQIIRFKREFE

SEQ ID NO: 71 - protein, 441 aa, Streptococcus pneumoniae
MDLLGFGTVIVHFLIISHSYRLICKGRINRKELYIFGAYTLLTEIVLEFSLYLLYLDKIGIERFLFPLGLYSYFRWMKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVMVIQNSCKMTMTPSGDLFALGFSTKGRNRGVGLNNVKELLDKYNNIILETEMEGSTFRQIIRFKREFE

SEQ ID NO: 72 - protein, 441 aa, Streptococcus pneumoniae
MDLLGFGTVIVHFLIISHSYRLICKGRINRKELYVFGAYTLLTEIVLEFSFYLLYLDKIGIERFLFPLGLYSYFRWMKQYERDRGLFLSLLLSLLYESTHNFLSVIFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTITPSGDLFALGFSTKGRNRGVGLNNVKELLDKYNNIILETEMEGSTFRQIIRFKREFE

SEQ ID NO: 73 - protein, 441 aa, Streptococcus pneumoniae
MDLFGFGTVIVHFLIISHSYHLICKGQINRKELFVFGAYTLLTEIVFDFPFYILYLDGLGIATFLFPLGLYSYFRWIKQYERDRGLFLSLLLSLLYESTHNFLPVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 74 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSSNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 75 - protein, 441 aa, Streptococcus pneumoniae
MDLFGFGTVIVHFLIISHSYHLICKGQINRKELFVFGAYTLLTEIVFDFPLYILYLDGLGIATFLFPLGLYSYFRWIKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 76 - protein, 441 aa, Streptococcus pneumoniae
MDLLGFGTVIVHFLIISHSYRLICKGRINRKELYVFGAYTLLTEIVLEFSFYLLYLDKIGIERFLFPLGLYSYFRWMKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVMVIQNSCKMTMTPSGDLFALGFSTKGRNRGVGLNNVKELLDKYNNIILETEMEGSTFRQIIRFKREFE

SEQ ID NO: 77 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSNFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 78 - protein, 441 aa, Streptococcus pneumoniae
MDLFGFGTVIVHLLIISHNYHLICKGQINRKELFVFGAYTLLTEIVFDFPLYILYLDGLGIAIFLFPLGLYSYFRWMKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 79 - protein, 441 aa, Streptococcus pneumoniae
MDLFGFGTVIVHFLIISHNYHLICKGQINRKELFVFGAYTLLTEIVFDFPLYILYLDGLGIATFLFPLGLYSYFRWIKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFSLGFSTKGRNRGVGLNNVKELLDKYNNIILETEMEGSTFRQIIRFKREFE

SEQ ID NO: 80 - protein, 441 aa, Streptococcus pneumoniae
MDLFGFGTVIVHFLIISHSYRLICKGRINRKELYVFGAYTLLTEIVLEFSFYLLYLKKIGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 81 - protein, 441 aa, Streptococcus pneumoniae
MDFFLLVDLILYFLIISHSYRLICKDQINRKELFFFGAYTLLTEIVLDFPFYLLYLDGLGIATFLFPLGLYSYFRWMKQYERDRGLFLSLLLSLLYESTHNFLSVTFSSITGDNFVLQYYGLFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRVYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKRKFE

SEQ ID NO: 82 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFVLLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 83 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGTLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 84 - protein, 441 aa, Streptococcus pneumoniae
  misc_feature (280)..(280): Xaa can be any naturally occurring amino acid
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLSVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKXNHKLRSDKYTYFDLNNIEDSALRSLVAQSIVYARNNGVEFTLEVKDTITKLPIELLDLVRIMSVLLNNAVEGSADSYKKQMEVAVIKMETETVVVIQNSCKMTMTPSGDLFALGFSTKGRNRGVGLNNVKELLDKYNNIILETEMEGSTFRQIIRFKREFE

SEQ ID NO: 85 - protein, 441 aa, Streptococcus pneumoniae
MDLFGFGTVIVHFLIISHSYHFICKGQINRKELFVFGAYTLLTEIVFDFPLYILYLDGLGIERFLFPLGLYSYFRWMKQYERDRGLFLSLLLSLLYESTHNFLYVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 86 - protein, 441 aa, Streptococcus pneumoniae
MDLFGFETVIVHFLIISHSYHFICKGQINRKELFVFGAYTLLTEIVFDFPLYILYLDGLGIERFLFPLGLYSYFRWMKQYERDRGLFLSLLLSLLYESTHNFLYVTFSSITGDNFVLQYHFPFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 87 - protein, 441 aa, Streptococcus pneumoniae
MDLFGFGTVIVHFLIISHNYHLICKGQINRKELFVFGAYTLLTEIVFDFPLYILYLDGLGIATFLFPLGLYSYFRWIKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETGTVIVIQNSCKMTMTPSGDLFSLGFSTKGRNRGVGLNNVKELLDKYNNIILETEMEGSTFRQIIRFKREFE

SEQ ID NO: 88 - protein, 441 aa, Streptococcus pneumoniae
MDLFGFGTVIVHFLIISHSYHLICKGQINRKELFVFGAYTLLTEIVFDFPLYILYLDGLGIATFLFPLGLYSYFRWIKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRVYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 89 - protein, 441 aa, Streptococcus pneumoniae
MDLFGFGTVIVHFLIISHSYHLICKGQINRKELFVFGAYTLLTEIVFDFPLYILYLDGLGIERFLFPLGLYSYFRWIKQYERDRGLFLSLLLSLLYESIHNFLSVTFSSITGDNFVLQYHFPFFFVVTVLTYFVTLKIIYYFHLELAYFDKDYLYPFLKKVFFALLLLHIISFVSDMVSTIKHLNSFGSILSSIVFISLLLTFFAMNSHKVQMEKEIALKQKKFEQKHLQNYTDEIVGLYNEIRGFRHDYAGMFVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 90 - protein, 441 aa, Streptococcus pneumoniae
MDLLGFGTVIVHFLIISHSYRLICKGRINRKELYVFGAYTLLTEIVLEFSFYLLSLDKIGIERFLFPLGLYSYFRWMKQYERDRGLFLSLLLSLLYESTHNFLSVTFSSITGDNFVLQYHFPFFFVVTVLTYFVTLKIIYYFHLELAYFDKDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

SEQ ID NO: 91 - protein, 441 aa, Streptococcus pneumoniae
MDFFLLVDLILYFLIISHSYRLICKDQINRKELFFFGAYTLLTEIVLDFPFYLLYLDGLGIATFLFPLGLYSYFRWMKQYERDRGLFLSLLLSLLYESTHNFLSVTFSSITGDNFVLQYYGLFFFVVTVLTYFVTLKIIYYFHLELAYFDEDYLYPFLKKVFFALLLLHIVSFVSDMVSTIKHLNSFGSILSSIVFISLLLTFFAMNSHKVQMEKEIALKQKKFEQKHLQNYTDEIVGLYNEIRGFRHDYAGMLVSMQMAIDSGNLQEIDRVYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKRKFE

SEQ ID NO: 92 - protein, 58 aa, Streptococcus pneumoniae
MRFIGDIFKLLKDTTWPTRKESWRDFRSIMEYTAFFVVIIYIFDQLIVSGLIRFINIF

SEQ ID NO: 93 - protein, 158 aa, Streptococcus pneumoniae
MKGVTNMTPEEMYLTERLDVQIAHFLKKSVQHRRRYKVLKITEIVAGFLIAVFCAIPMPGDRYRLISVALSSLGLLCEGIINLYNAKEHWISYQKTAQLLEREKFLYQCQTEKYAGKTKAFALFVKTCEGLISEEINQWESIQSKEVAASADAPGKKE

SEQ ID NO: 94 - protein, 158 aa, Streptococcus pneumoniae
MKGVTNMTPEEMYLTERLDVQIAHFLKKSVQHRRRYKVLKITEIVAGFLIAVFCAIPMPGDRYRLISVALSSLGLLCEGIINLYNAKENWISYQKTAQLLEKEKFLYQCQTEKYAGKTKAFALFVKACEGLISEEINQWESIQSKEVAASADAPVKKE

SEQ ID NO: 95 - protein, 158 aa, Streptococcus pneumoniae
MKGVTNMTPEEMYLTERLDIQIAHFLKKSVQHRRRYKVLKITEIVAGFLIAVFCAIPMPGDRYRLISVALSSLGLLCEGIINLYNAKENWISYQKTAQLLEKEKFLYQCQTEKYAGKTKAFALFVKTCEGLISEEINQWESIQSKEVAASADAPVKKE

SEQ ID NO: 96 - protein, 435 aa, Streptococcus pneumoniae
MKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMVAFKKLHAFDMEDV

SEQ ID NO: 97 - protein, 435 aa, Streptococcus pneumoniae
MKGVNMEKQQPSKAALLSIIPGLGQIYNKQKAKGFIFLSVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 98 - protein, 435 aa, Streptococcus pneumoniae
MKGVNMEKQQPSKAALLSIIPGLGQIYNKQKAKGFIFLGVTIVFVLYFLALATPELSNLITLGNKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 99 - protein, 435 aa, Streptococcus pneumoniae
MKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVSLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 100 - protein, 435 aa, Streptococcus pneumoniae
MKGVNMEKQQPSKAALLSIIPGLGQIYNKQKAKGFIFLGVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANTWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 101 - protein, 435 aa, Streptococcus pneumoniae
MKGVNMEKQQPSKAALLSIIPGLGQIYNKQKAKGFIFLSVTIVFVLYFLALATPELSNLITLGDKPGRDNSLFMLIRGAFHLIFVIVYVLFYFSNIKDAHTIAKRINNGIPVPRTLKDMIKGIYENGFPYLLIIPSYVAMTFAIIFPVIVTLMIAFTNYDFQHLPPNKLLDWVGLTNFTNIWSLSTFRSAFGSVLSWTIILALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 102 - protein, 435 aa, Streptococcus pneumoniae
MKGVIMEKQQPSKAALLSIIPGLGQIYNKQKAKGFIFLGVTIVFVLYFLALAAPELSNLITLGDKPGRDNSLFMLIRGAFHLIFVVVYVLFYFANIKDAHTIAKRINNGIPVPRTLKDMIKGIYENGFPYLLIIPSYVAMTFAIIFPVIVTLMIAFTNYDFQHLPPNKLLDWVGLTNFSNIWSLSTFRSAFGSVLSWTIIWALAASTLQIVIGIFTAIIANQPFIKGKRIFGVIFLLPWAVPAFITILTFSNMFNDSVGAINTQVLPIFAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNGGGPGSVGGGAGSTDILISWIYRLTTGTSPQYSMAAAVTLIISIIVISISMIAFKKLHAFDMEDV

SEQ ID NO: 103 - protein, 435 aa, Streptococcus pneumoniae
MKGVIMEKQQPSKAALLSIIPGLGQIYNKQKAKGFIFLGVTIVFVLYFLALAAPELSNLITLGDKPGRDNSLFMLIRGAFHLIFVVVYVLFYFSNIKDAHTIAKRINNGIPVPLTLKDMIKGIYENGFPYLLIIPSYVAMTFAIIFPVIVTLMIAFTNYDFQHLPPNKLLDWVGLTNFTNIWSLSTFRSAFGAVLSWTIIWALAASTLQIVIGIFTAIIANQPFIKGKRIFGVIFLLPWAVPAFITILTFSNMFNDSVGAINTQVLPILAKFLPFLDGALIPWKTDPTWTKIALIMMQGWLGFPYIYVLTLGILQSIPNDLYEAAYIDGANAWQKFRNITFPMILAVAAPTLISQYTFNFNNFSIMYLFNAGGPGSVGGGAGSTDILISWIYRLTTGTSPQYSMAAAVTLIISIIVISISMIAFKKLHAFDMEDV

SEQ ID NO: 104 - protein, 164 aa, Streptococcus pneumoniae
MRQLKRVGVFLLLPFFVLIDAHISQLLGSFFPHVHLASHFLFLFLLFETIEVSEYLYLVYCFVIGLVYDIYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 105 - protein, 164 aa, Streptococcus pneumoniae
MRQLKRVGVFLLLPFFVLIDAHISQLLGSFFPHVHLASHFLFLFLLFETIEVSEYLYLVYCFVIGLVHDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 106 - protein, 164 aa, Streptococcus pneumoniae
MRQLKRVGVFLLLPFFVLIDAHISQLLGSFFPHVHLASHFLFLFLLFETIEVSEYLYLVYCFVIGLIYDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 107 - protein, 164 aa, Streptococcus pneumoniae
MRQLKRVGVFLLLPFFVLIDAHISQLLGSFFPHVHLASHFLFLFLLFETIEVSEYLYLVYCFVTGLVYDVYFFHLIGITTLLFILLGAFLHKLNSVILLNRWTRMLAMIVLTFLFEMGSYLLAFMVGLTVDSMSIFIVYSLVPTMILNFLWITVFQFIFEKYYL

SEQ ID NO: 108 - protein, 164 aa, Streptococcus pneumoniae
MRQLKRVGVFLLLPFFVLIDAHISQLLGSFFPHVHLASHFLFLFLLFETIEVSEYLYLVYCFVIGLVYDVYFFHLIGIATLLFILLGAFLHKLNSVILLNRWTRILAMIVLSFLFDMGTYLFALVVGLTLDSLPIFIVYSLVPSMILNLVWMLIFQFIFERYYL

SEQ ID NO: 109 - protein, 271 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFASLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 110 - protein, 271 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALTLSALGHFALGM

SEQ ID NO: 111 - protein, 271 aa, Streptococcus pneumoniae
MTNSNYKLTKEDFNQINKRRLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSALGHFALGM

SEQ ID NO: 112 - protein, 271 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATMINFEISYKLPIGEKMIDFQDILNQIFPRLLPAIFTAFIFWLLGKKGMNSTKAIGIIIVLALALSALGHFAFGM

SEQ ID NO: 113 - protein, 271 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKLPIGEKMIDFQDILNQIFPRLLPAIFTAFIFWLLGKKGMNSTKAIGIIIVLALALSTLGHFALGM

SEQ ID NO: 114 - protein, 271 aa, Streptococcus pneumoniae
MTNSNYKLTKEDFNQINKRSLFTFQLGWNYERMQASGYLYMILPQLRKIYGDGTPELKEMMKVHTQFFNTSPFFHTIIAGFDLAMEEKDGVGSKDAVNGIKTGLMGPFAPLGDTIFGSLVPAIMGSVAATMAIAGQPWGIFLWIAVAVAYDIFRWKQLEFAYKEGVNLINNMQSTLTALIDAASVLGVFMMGALVATVINFEISYKWAIGEKMIDFQDILNQIFPRLLPAIFTAFIFWLLGKKGMNSTKAIGIIIVLALALSAFGKFVLGM

SEQ ID NO: 115 - protein, 273 aa, Streptococcus pneumoniae
MTNSNYKLTKEDFNQINKRSLFTFQLGWNYERMQASGYLYMILPQLRKMYGDGTPELKEMMKVHTQFFNTSPFFHTIIAGFDLAMEEKDGVGAKDAVNGIKTGLMGPFAPLGDTIFGSLVPAIMGSVAATMAIAGQPWGIFLWIAVAVAYDIFRWKQLEFAYKEGVSLINNMQSTLTALIDAASVLGVFMMGALVATLINFEVSYKLPIGEKMIDFQDILNSIFPRLLPAIFTAFIFWLLGKKGMNSTKAIGIIIVLALALSAFGKFVLGMGA

SEQ ID NO: 116 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSIRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 117 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINVVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 118 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSVRYIKPNAEHWFGTDSNGKSLFDGVWFGARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVVKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 119 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSIRYIKPNAEHWFGTDSNGKSLFDGVWFVARNSILISVIATVINLVIGVFVGGIWGISKSVDRVMMEVYNVISNIPPLLIVIVLTYSIGAGFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 120 - protein, 308 aa, Streptococcus pneumoniae
MSTIDKEKFQFVKRDDFASETIDAPAYSYWKSVFKQFMKKKSTVVMLGILVAIILISFIYPMFSKFDFNDVSKVNDFSIRYIKPNAEHWFGTDSNGKSLFDGVWFGARNSILISVIATVINLVIGVFVGGIWGISKSVDRVMMEVYNVISNIPPLLIVIVLTYSIGARFWNLIFAMSVTTWIGIAFMIRVQILRYRDLEYNLASRTLGTPTLKIVAKNIMPQLVSVIVTTMTQMLPSFISYEAFLSFFGLGLPITVPSLGRLISDYSQNVTTNAYLFWIPLTTLVLVSLSLFVVGQNLADASDPRTHR

SEQ ID NO: 121 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAQKIGFVNNFKGLSMIGISIVGIFLAVLHFKNSQKVAVAAPSTPSESGEIEDDEF

SEQ ID NO: 122 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVAYGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 123 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVVVAAPSTPSESGEIEDDEF

SEQ ID NO: 124 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERYDYKGIERNYLLGAIPWALSRALPVFFALAFGGAFVQHVVDLVTEYQWIADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 125 - protein, 301 aa, Streptococcus pneumoniae
MIQWWQILLLTLYSAYQICDELTIVSSAGSPVFAGFITGLVMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 126 - protein, 301 aa, Streptococcus pneumoniae
MIQWWQILLLTLYSAYQICDELTIVSSAGSPVFAGFITGLIMGDVTIGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 127 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERYDYKGIERNYLLGAIPWALSRALPVFFALAFGGAFVQSVVDFVEAYKWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 128 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDAPLAITTIAVPVAALLTYFDVLGRMTTTFFAHRVDAAIERFDYKGIERNYLLGAIPWALSRALPVFFALAFGGEFVQGVVDFVTEYQWVADGLTLAGRMLPGLGFAILLRYLPVKRNLHYLAMGFGLTAMLTVLYSYVTGLGGAVAGIVGTLPAEVAEKIGFVNNFKGLSMIGISIVGIFLAVLHFKNSQKVAVAAPSTPSESGEIEDDEF

SEQ ID NO: 129 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDTALAITTIAVPVAALLTYFDVLGRMTTTFFAHRVDAAIERFDYKGIERNYLLGAIPWALSRALPVFFALAFGGAFVQSVVDLVEAYKWVADGLTLAGRMLPGLGFAILLRYLPVKRNLHYLAMGFGLTAMLTVLYSYVTGLGGAVAGVIGTLPKDVAEKIGFVNNFKGLSMIGISIVGIFLAVLHFKNSQKVAVAAPSTPSESGEIEDDEF

SEQ ID NO: 130 - protein, 301 aa, Streptococcus pneumoniae
MIQWWQILLLTLYSAYQICDELTIVSSAGSPVFAGFITGLIMGDVTTGLLIGGNLQLFVLGVGTFGGASRIDATSGAVLATAFSVSQGIDTALAITTIAVPVAALLTYFDVLGRMTTTFFAHRVDAAIERFDYKGIERNYLLGAIPWALSRALPVFFALAFGGEFVQHVVDFVTKYQWVADGLTLAGRMLPGLGFAILLRYLPVKRNLHYLAMGFGLTAMLTVLYSYVTGLGGAVAGIVGTLPKDVAEKIGFVNNFKGLSMIGISIVGIFLAVLHFKNSQKVAVAAPSTPSESGEIEDDEF

SEQ ID NO: 131 - protein, 269 aa, Streptococcus hyointestinalis
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDDKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 132 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLPN

SEQ ID NO: 133 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYRSIGANRPYRDSITDATNGVGQILMTAVYREQWIFWAATNVFSIYLWWGESLQIQGKYLIYLINSLVGWYQWSKAAKQNTDLLN

SEQ ID NO: 134 - protein, 269 aa, Streptococcus pneumoniae
MMHTYLQKKIENIKTTLGEMSGGYRRMVAAMADLGFSETMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 135 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTTVYREQWIFWAATNVFSIYLWWGESLQIQGKYLIYLINSLVGWYQWSKAAKQNTDLLN

SEQ ID NO: 136 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWAKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 137 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDCIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 138 - protein, 269 aa, Streptococcus pneumoniae
MMHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQARFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 139 - protein, 269 aa, Streptococcus pneumoniae
MIHTYLQKKIENIKTTLGEMSGGYRRMVAAMADLGFSGTMKAIWDDLFAHRSFAQWIYLLVLGSFPLWLELVYEHRIVDWIGMICSLTGIICVIFVSEGRASNYLFGLINSVIYLILALQKGFYGEVLTTLYFTVMQPIGLLVWIYQAQFKKEKQEFVARKLDGKGWTKYLSISVLWWLAFGFIYQSIGANRPYRDSITDATNGVGQILMTAVYREQWIFWAATNVFSIYLWWGESLQIQGKYLIYLINSLVGWYQWSKAAKQNTDLLN

SEQ ID NO: 140 - protein, 274 aa, Streptococcus pneumoniae
MKKKLKLTSLLGLSLLIMTACATNEVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGQFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 141 - protein, 274 aa, Streptococcus pneumoniae
MKKKLKLTSLLGLSLLIMTACATNGVTSDITAESADFWSKLVYFFAKIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 142 - protein, 274 aa, Streptococcus pneumoniae
MKKKLKLTSLLGLSLLIMTACATNGVTSDITAESADFWSKLVYFFAEIIRFLSFDISIGVGIILFTILIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 143 - protein, 274 aa, Streptococcus pneumoniae
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGGVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 144 - protein, 274 aa, Streptococcus pneumoniae
MKKKLKLTSLLGLSLLIMTACATNGVTSDITAESADFWSKSVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 145 - protein, 274 aa, Streptococcus pneumoniae
MKKKLKLTSLLGLSLLIMTACATNGVTSDITAESADFWSKLVYFFAKIIRFLSFDISIGVGIILFTVLICTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 146 - protein, 274 aa, Streptococcus pneumoniae
MKKKLKLTSLLGLSLLIMTACATNGVTSDITAESADFWSKLVYFFAKIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQTQKDLENRKRKAKKKAQKTK

SEQ ID NO: 147 - protein, 274 aa, Streptococcus pneumoniae
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVTLYWTVSNAYQVLQTYFLNNPFKIIAEREAVAQAQKDLENRKRKAKKKAQKTK

SEQ ID NO: 148 - protein, 274 aa, Streptococcus pneumoniae
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLILIFAVYAPGGVALYWTVSNAYQVLQTYFLNNPFKIIAEREAVVQAQKDLENRKRKAKKKAQKTK

SEQ ID NO: 149 - protein, 274 aa, Streptococcus pneumoniae
MKKKLKLTSLLGLSLLIMTACATNGVTSDITAESADFWSKLVYFFAEIIRFLSFDISIGVGIILFTVLIRTVLLPVFQVQMVASRKMQEAQPRIKALREQYSGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 150 - protein, 274 aa, Streptococcus pneumoniae
MKKKLKLTSLLGLSLLIMAACATNGVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGHFLWINLGSVDTTLVLPILAAVFTFLSTWLSNKALSERNGATTAMMYGIPVLIFIFAVYAPGGVALYWTVSNAYQVLQTYFLNNPFKIIAEREAVVQAQKDLENRKRKAKKKAQKTK

SEQ ID NO: 151 - protein, 274 aa, Streptococcus pneumoniae
MKKKLKLTSLLGLSLLIMTACATNEVTSDITAESADFWSKLVYFFAEIIRFLSFDISIGVGIILFTVLIRTVLLPVFQVQMVASRKMQEAQPRIKALREQYPGRDMESRTKLEQEMRKVFKEMGVRQSDSLWPILIQMPVILALFQALSRVDFLKTGQFLWINLGSVDTTLVLPILAAVFTFLSTWLSNKALSERNGATTAMMYGIPVLIFIFAVYAPGGVALYWTVSNAYQVLQTYFLNNPLKIIAEREAVVQAQKDLENRKRKAKKKAQKTK

SEQ ID NO: 152 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIVLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 153 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIILIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 154 - protein, 181 aa, Streptococcus pneumoniae
MKKEQIPNLLTIGRILFIPIFLFILTIGNSIESHIVAAIIFAVASITDYLDGYLARKWNVVSNFGKFADPMADKLLVMSAFIMLIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 155 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILASAMPGKIKTFSQMFAIIFLLLHWTLLGQVLLYVALFFTIYSGYDYFKGSAYVFKGTFGSK

SEQ ID NO: 156 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILAAAIPGKIKTFSQMFAIIFLLLHWTLLGQVLLYVALFFTIYSGYDYFKGSAYVFKGTFGSK

SEQ ID NO: 157 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMFIELGMAPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 158 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMDPAWIVAVIICRELAVTGLRLLLVETGGTILAAAMPGKIKTFSQMFAIIFLLLHWTLLGQVLLYVALFFTIYSGYDYFKGSAYVFKGTFGSK

SEQ ID NO: 159 - protein, 181 aa, Streptococcus pneumoniae
MKKEQIPNLLTIGRILFIPIFIFILTIGNSIESHIVAAIIFAVASITDYLDGYLARKWNVVSNFGKFADPMADKLLVMSAFIMLIELGMAPAWIVAVIICRELAVTGLRLLLVETGGTILASAMPGKIKTFSQMFAIIFLLLHWTLLGQVLLYVALFFTIYSGYDYFKSSAYVFKGTFGSK

SEQ ID NO: 160 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 161 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 162 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEDQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 163 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNTLYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 164 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 165 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGKTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 166 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 167 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALSAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 168 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 169 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGQLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 170 - protein, 436 aa, Streptococcus pneumoniae
MIHLIMISAIALAIGIGYRTKINIGLLAIAFSYLIAITLMGLSPKELLHFWPTSLFFTIFSVSLFYNVAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 171 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 172 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 173 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTISIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 174 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 175 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALKLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 176 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMVVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 177 - protein, 436 aa, Streptococcus pneumoniae
MIHLIMISAIALAIGIGYRTKINIGLLAIAFSYLIATTLMGLSPKELLHFWPTSLFFTIFSVSLFYNVATTNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIVWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 178 - protein, 436 aa, Streptococcus pneumoniae
MIHLIMISAIALAIGIGFRTKINIGLLAIAFSYLIATTLMGLSPKELLHFWPTSLFFTIFSVSLFYNVATTNGTLDVLAQHILYRTRTHPNALYMILYLMATLLSALGAGFFATMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 179 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTHPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYQKTFDIGFVSILMVCLALRLKLGKQEAILAKVPWATIIMLCGMSLLMSLAVKSGLVTLIGHLMTTTIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLGLLTTWILILLASLS

SEQ ID NO: 180 - protein, 436 aa, Streptococcus pneumoniae
MIHLIMISAIALAIGIGYRTKINIGLLAIAFSYLIATTLMGLSPKELLHFWPTSLFFTIFSVSLFYNVAITNGTLDVLAQHILYRTRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERGLAFKKQIILGVPISLSLELLTTWILILLASLS

SEQ ID NO: 181 - protein, 436 aa, Streptococcus pneumoniae
MIHLIMISAIALAIGIGYRTKINIGLLAIAFSYLIATTLMGLSPKELLHFWPTSLFFTIFSVSLFYNFAITNGTLDVLAQHILYRIRTYPNALYMILYLMATLLSALGAGFFTTMAVCCPLAITLCQKADKHPLIGAQAVNWGASGGANLITSSSGIVFQGLFKQMGWEEQAFSLGNHIFIVSIIYPLIVLLLLSCYSHYSKGRTNSSLTIDQPPLLSKVQRQTTLLMISSMVLVWLFPLLHLIFPNIAWIATYRKTFDIGFVSILMVCLALRLKLGKQEAILAKVPWATIIMLCGMSLLMSLAVKSGLVTLIGHLMTTSIPHFWLPLFFCVIAGVMSLFSSTLSVVAPALFPIIAIISAQNPQIDIHLLTTATVIGALSTNISPFSSAGSLIQLSLPNIEERALAFKKQIILGVPISLSLGLLTTWILILLASLS

SEQ ID NO: 182 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLLGIVLGWGLPGIWAGSLLDNGFRWLFLRYRYQRYMSLKG

SEQ ID NO: 183 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGNGNARLPFYATSIGMWCIRIGTGYLMGIVLGWGLPGIWAGSLLDNGFRWLFLRYRYQRYMSLKG

SEQ ID NO: 184 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGITGVAWGTILSRLVGLVILWSQLKLPYGKLTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAIWQGLGNARLPFYATSIGMWCIRIGTGYLLGIVLGWGLPGIWAGSLLDNGFRWLFLRYRYQRYMSLKG

SEQ ID NO: 185 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 186 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 187 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGITGVAWGTILSRLVGLVILWSQLKLPYGKLTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 188 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMNLKG

SEQ ID NO: 189 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLLGGSIVLLGLMTSLGALIRATHNPRLPLYVSFLSNALNILFSSLAIFVLDMGIAGVAWGTIVSRLVGLVILWSQLKLPYGKLTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 190 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 191 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLLLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 192 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTETVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMNLKG

SEQ ID NO: 193 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYEKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 194 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYEKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 195 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKLTFGLDKELLTLALPAAGERLMMRAGDVVIIALVVSFGTEAVAGNAIGEVLTQFNYMPAFGVAMATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 196 - protein, 411 aa, Streptococcus pneumoniae
  misc_feature (159)..(159): Xaa can be any naturally occurring amino acid
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSXAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 197 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLVVEASVLVTLFSLLGTPMTTGTVIYTAVWQGLGNARLPFYATSIGMWCIRIGTGYLMGIVLGWGLPGIWAGSLLDNGFRWLFLRYRYQRYMSLKG

SEQ ID NO: 198 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTIVSRLVGLVILWSQLKLPYGKPTFGLDRELLTLALPAAGERLMMRAGDVVIIALVVSFGTEAVAGNAIGEVLTQFNYMPAFGVATATVMLLARAVGEDDWKRVASLSKQTFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 199 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGIAGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQTFWLSLFLMLPLYFSIYVLGVPLTHLYTTDSLAVEASVLVTLFSLLGTPMTTGTVIYTAVWQGLGNARLPFYATSIGMWCIRIGTGYLLGIVLGWGLPGIWAGSLLDNGFRWLFLRYRYQRYMSLKG

SEQ ID NO: 200 - protein, 411 aa, Streptococcus pneumoniae
MGENFLQMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGITGVAWGTILSRLVGLVILWSQLKLPYGKLTFGLDKELLTLALPAAGERLMMRAGDVVIIALVVSFGTEAVAGNAIGEVLTQFNYMPAFGVATATVMLLARAVGEDDWKRVASLSKQTFWLSLFLMLLLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 201 - protein, 411 aa, Streptococcus pneumoniae
MGENFLHMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGITGVAWGTILSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQIFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 202 - protein, 411 aa, Streptococcus pneumoniae
MGENFLHMLMGMVDSYLVAHLGLIAISGVSVAGNIITIYQAIFIALGAAISSVISKSIGQKDQSKLAYHVTEALKITLLLSFLLGFLSIFAGKEMIGLLGTERDVAESGGLYLSLVGGSIVLLGLMTSLGALIRATHNPRLPLYVSFLSNALNILFSSLAIFVLDMGITSVAWGTIVSRLVGLVILWSQLKLPYGKPTFGLDKELLTLALPAAGERLMMRAGDVVIIALVVSFGTEAVAGNAIGEVLTQFNYMPAFGVATATVMLLARAVGEDDWKRVASLSKQIFWLSLFLMLPLSFSIYVLGVPLTHLYTTDSLAVEASVLVTLFSLLGTPMTTGTVIYTAVWQGLGNARLPFYATSIGMWCIRIGTGYLMGIVLGWGLPGIWAGSLLDNGFRWLFLRYRYQRYMILKG

SEQ ID NO: 203 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 204 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 205 - protein, 285 aa, Streptococcus pneumoniae
MNYPKIDLKTIRQESKHFQADTPRLFLLYILPSMLVILSGFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCHSLDLGQVPPRRILKTSRSFMKGYKFQHFVLDLQLLPWYFLNWITFGIASFSLLPYIQCTKIMFYRAVLARKRPKA

SEQ ID NO: 206 - protein, 285 aa, Streptococcus pneumoniae
MNYPKIDLKTIRQESKHFQADTPRLFLLYILPSMLVILSSFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 207 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFILDLQLLPWYFLNWITFGIASFSLLPYIQCTKIMFYRAVLARKRPKA

SEQ ID NO: 208 - protein, 285 aa, Streptococcus pneumoniae
MNYPKIDLKTIRQESKHFQADTPRLFLLYILPSMLVILSSFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 209 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIHLLFYSSFLAKKFVTLHPEFPSLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 210 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYQAVLARKRPKA

SEQ ID NO: 211 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLAGLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 212 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVFFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 213 - protein, 285 aa, Streptococcus pneumoniae
MNYPKIDLKTIRQESKHFQADTPRLFLLYILPSMLVILSSFLNPLSRIHGTVLEQPFFSILGQILQAYLFPLLVFFIGTILLTSSVYATLTLMKDSKTEPSVKNSLALFDEERFSQTFLTLLLKRFYLFLWSIPNLLGIYLLFYSSFLAQKFVTLHPEFPNLDLSSVETDRFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 214 - protein, 285 aa, Streptococcus pneumoniae
MNYPKIDLKTIRQESKHFQADTPRLFLLYILPSMLVILSGFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLIPWYFLNWITFGIASFSLLPYIQCTKIMFYRAVLARKRPKA

SEQ ID NO: 215 - protein, 285 aa, Streptococcus pneumoniae
MNYPKIDLKTIRQESKHFQADTPRLFLLYILPSMLVILSGFLNPLSRIHGTVLEQPFFSILGQILQTYLFPLLVSFIRTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 216 - protein, 285 aa, Streptococcus pneumoniae
MNYPKIDLKTIRQESKHFQADTPRLFLLYILPSMLVILSGFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFATLHPEFPNLDLSSVETERFLMVFGLYFLASLILIIVGNILYIPQYYAYSQVEFLLCHSLDLGQVPPRRILKTSRSFMKGYKFQHFVLDLQLLPWYFLNWITFGIASFSLLPYIQCTKIMFYRAVLARKRPKA

SEQ ID NO: 217 - protein, 285 aa, Streptococcus pneumoniae
MNYPKIDLKTIHQESKHFQADTPRLFFLYILPSMLVILSSFLNPLSRIHGTVLEQPFFSILGQILQTYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQHFVLDLQLLPWYFLNWITFGIASFSLLPYIQCTKIMFYRAVLARKRPKA

SEQ ID NO: 218 - protein, 285 aa, Streptococcus pneumoniae
MNYPKIDLKTIRQESKHFQADTPRLFLLYILPSMLVILSGFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKIMFYRAVLARKRPKA

SEQ ID NO: 219 - protein, 285 aa, Streptococcus pneumoniae
MNYPKIDLKTIRQESKHFQADTPRLFLLYILPSMLVILSGFLNPLSRIHGTVLEQPFFSILGQILQAYLFPLLVSFIGTILLTSSVYATLTLMKDSKTEPSVKNSLALFDEERFSQTFLTLLLKRFYLFLWSIPNLLGIYLLFYSSFLAKKFVTLHPEFPNLDLSSVETERFLMVFGLYFLASLILIIVGNILYIPQYYAYSQVEFLLCYSLDLGQVPPRRILKTSRSFMKGYKFQRFVLDLQLLPWYFLNWITFGIASFSLLPYIQCTKLMFYRAVLARKRPKA

SEQ ID NO: 220 - protein, 299 aa, Streptococcus pneumoniae
MRNMKAKYAVWVAFFLNLTYAIVEFIAGGVFGSSAVLADSVHDLGDVIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 221 - protein, 299 aa, Streptococcus pneumoniae
MRNMKAKYAVWVAFFLNLTYAIVEFIAGGVFGSSAVLADSVHDLGDVIAIGISAFLETISNREEDNQYTLGYKRFSLLGAVVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSDLERLDNVASLNQLNLWTMDALEKNAIVHVCLKEMEHMETCKESIRIFLKDCGFQNITIEIDADLETHQTHKRKVCDLERSYEHQH

SEQ ID NO: 222 - protein, 299 aa, Streptococcus pneumoniae
MRNMKAKYAVWVAFFLNLTYAIVEFIAGGVFGSSAVLADSVHDLGDAIAIGISAFLELISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 223 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGALVTAVILVTGSVLVILENVTKILHPQPVNDEGILWLGIIAITINLLASLVVGKGKTKNESILNLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 224 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 225 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILNLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 226 - protein, 299 aa, Streptococcus pneumoniae
MRNMKAKYAVWVAFFLNLTYAIVEFIAGGVFGSSAVLADSVHDLGDAIAIGMSAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEYMETCKESIRIFLKDCGFQNITIEIDADLETHQTHKRKVCDLERSYEHQH

SEQ ID NO: 227 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVIAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALSRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 228 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 229 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 230 - protein, 299 aa, Streptococcus pneumoniae
MRNMKAKYAVWVAFFLNLTYAIVEFIAGGVFGSSAVLADSVHDLGDVIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 231 - protein, 299 aa, Streptococcus pneumoniae
MRNMKAKYAAWVAFFLNLTYAIVEFIAGGVFGSSAVLADSVHDLVDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 232 - protein, 299 aa, Streptococcus pneumoniae
MRNMKAKYAVWVAFFLNLTYAIVEFIAGGVFGSSAVLADSVHDLGDVIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 233 - protein, 299 aa, Streptococcus pneumoniae
MRNMKAKYAVWVAFFLNLTYAIVEFIAGGVFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKVLPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 234 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGAVVTAVILVTGSVLVILENVTKILHPQPVNDEGILWLGIIAITINLLASLVIGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 235 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGAVVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 236 - protein, 299 aa, Streptococcus pneumoniae
MRNMKAKYAVWVAFFLNLTYAIVEFIAGGIFGSSAVLADSVHDLVDAIAIGISAFLETISNREEDNQYTLGYKRFSLLGALVTAVILVTGSVLVILENVTKILHPQPVNDEGILWLGIIAITINMLASLVVGKGKTKNESILSLHFLEDTLGWVAVILMAIVLRFTDWYILDPLLSLVISFFILSKALPRFWSTLKIFLDAVPEGLDIKQVKSGLERLDNVASLNQLNLWTMDALEKNAIVHVCLKEMEHMETCKESIRIFLKDCGFQNITIEIDADLETHQTHKRKVCDLERSYEHQH

SEQ ID NO: 237 - protein, 299 aa, Streptococcus pneumoniae
MRNMKAKYAVWVAFFLNLTYAIVEFIAGGIFGSSAVLADSVHDLGDAIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRNFLKDCGFQNITIEIDADLETHQTHKRKVCDLERSYEHQH

SEQ ID NO: 238 - protein, 299 aa, Streptococcus pneumoniae
MRNMKAKYAAWVAFFLNLTYTIVEFIAGGVFGSSAVLADSVHDLGDVIAIGISAFLETISNREEDNQYTLGYKRFSLLGALVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSGLERLDNVVSLNQLNLWTMDALEKNAIVHVCLKEMEHMETCKESIRIFLKDCGFQNITIEIDADLETHQTHKRKVCDLERSYEHQH

SEQ ID NO: 239 - protein, 299 aa, Streptococcus pneumoniae
MRNMKAKYAVWVAFFLNLTYAIVEFIAGGVFGSSAVLADSVHDLGDVIAIGISAFLETISNREEDNQYTLGYKRFSLLGAVVTAVILVTGSVLVILENVTKILHPQPVNDEGILWLGIIAITINLLASLVVGKGKTKNESILSLHFLEDTLGWVAVILMAIVLRFTDWYILDPLLSLVISFFILSKALPRFWSTLKIFLDAVPEGLDIKQVKSDLERLDNVASLNQLNLWTMDALEKNAIVHVCLKEMEHMETCKESIRIFLKDCVFQNITIEIDADLETHQTHKRKVCDLERSYEHQH

SEQ ID NO: 240 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 241 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 242 - protein, 449 aa, Streptococcus pneumoniae
MKPEFLESAEFYNRRYHNFSSRVIVPMSLLLVFLLGFATFAEKEISLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQIKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 243 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLINQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 244 - protein, 449 aa, Streptococcus pneumoniae
MKPEFLESAEFYNRRYHNFSSSVIVPMALLLVFLLGFATVAEKEMSLSTRATIEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSATQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 245 - protein, 449 aa, Streptococcus pneumoniae; identical to SEQ ID NO: 241

SEQ ID NO: 246 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQGGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGTLLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 247 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 248 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGELLVQYQEGVEGVQAESYASQLDMLKDQKKQLEYLQKSLQEGENHFPEEDKFGYQATFRDYISQEGSLRASTSQQNETIASQNAAASQTQAEIGNLISQTEAKIRDYQTVKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 249 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQIKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 250 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGTEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 251 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQSEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQFFLDSTITSIDATATKTEKGNFFKIEAETNLTSEQAEKLRYGVEGRLQMITGKKSYLRYYLDQFLNKE

SEQ ID NO: 252 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTVKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAEINLTSEQAEKLRYGVEGRLQMITGKKSYLRYYLDQFLNKE

SEQ ID NO: 253 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLAGQNLAYSLYQSYKSQGEENPQTKVQAVAQVEAQISQLESSLATYRVQYAGSGTQQAYASGLSSQLESLKSQHLAKVGQELSLLAQKILEAESGKKVQGNLLDKGKITASEDGVLHLNPETSDSSMVAEGTLLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 254 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQSEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 255 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENRFPEEDKFGYQATFRDYISQAGSLRASTSQQNETIASQNAAASQTQAEIGNLINQTEAKIRDYQTAQSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 256 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFREYISQAGSLRASTSQQNETIASQNAAASQTQAEIGNLINQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 257 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKNVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 258 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLAGQNLAYSLYQSYKSQGEENPQTKVQAVAQVEAQISQLESSLATYRVQYAGSGTQQAYASGLSSQLESLKSQHLAKVCQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 259 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSFYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 260 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKVTASEDGVLHLNPETSDSSMVAEGALLAQLYPSLEREGKAKLTAYLSSKYVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 261 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLINQTEAKIRDYQTAQSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 262 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKTKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 263 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQSEIGNLISQTEAKIRDYQTAKSAMETGASLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 264 - protein, 449 aa, Streptococcus pneumoniae
MKPEFLESAEFYNRRYHNFSSSVIVPMALLLVFLLGFATIAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLASQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 265 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGTSLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQFFLDSTITSIDATATKTEKGNFFKIEAETNLTSEQAEKLRYGVEGRLQMITGKKSYLRYYLDQFLNKE

SEQ ID NO: 266 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQGGENHFPEEDKFGYQATFRDYISQAGSLRASTSQQNETIASQNAAASQTQAEIGNLISQTEAKIRDYQTAKSAMETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 267 - protein, 449 aa, Streptococcus pneumoniae; identical to SEQ ID NO: 254

SEQ ID NO: 268 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGHQATFRDYISQAGSIRASTSQQNETIASQNAAASQTQSEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 269 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQSEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAEINLTSEQAEKLRYGVEGRIQMITGKKSYLRYYLDQFLNKE

SEQ ID NO: 270 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQSEIGNLISQTEAKIRDYQTAKSAIETGASLAGQNLAYSFYQSYKSQGEENPQTKVQVVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 271 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHSEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTAKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKVTASEDGVLHLNPETSDSSMVAEGALLAQLYPSLEREGKAKLTAYLSSKYVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 272 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQVGSLRASTSQQNETIASQNAAASQTQAEIGNLISQTEAKIRDYQTVKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAEINLTSEQAEKLRYGVEGRLQMITGKKSYLRYYLDQFLNKE

SEQ ID NO: 273 - protein, 449 aa, Streptococcus pneumoniae
MKPEFLESAEFYNRRYHNFSSSVIVPMALLLVFLLGFATVAEKEMSLSTRATVEPSRILANIQSTSNNRILVNHLEENKLVKKGDLLVQYQEGAEGVQAESYASQLDMLKDQKKQLEYLQKSLQEGENHFPEEDKFGYQATFRDYISQAGSLRASTSQQNETIASQNAAASQTQAEIGNLISQTEAKIRDYQTVKSAIETGASLAGQNLAYSLYQSYKSQGEENPQTKVQAVAQVEAQISQLESSLATYRVQYAGSGTQQAYASGLSSQLESLKSQHLAKVGQELTLLAQKILEAESGKKVQGNLLDKGKITASEDGVLHLNPETSDSSMVAEGALLAQLYPSLEREGKAKLTAYLSSKDVARIKVGDSVRYTTTHDAGNQLFLDSTITSIDATATKTEKGNFFKIEAETNLTSEQAEKLRYGVEGRLQMITGKKSYLRYYLDQFLNKE

SEQ ID NO: 274 - protein, 220 aa, Streptococcus pneumoniae
MKCLLCGQTMKTVLTFSSLLLLRNDDSCLCSDCDSTFERIGEENCPNCMKTELSTKCQDCQLWCKEGVEVSHRAIFTYNQAMKDFFSRYKFDGDFLLRKVFASFLSEELKKYKEYQFVVIPLSPDRYANRGFNQVEGLVEAAGFEYLDLLEKREERASSSKNRSERLGTELPFFIKSGVTIPKKILLIDDIYTTGATINRVKKLLEEAGAKDVKTFSLVR

SEQ ID NO: 275 - protein, 392 aa, Streptococcus pneumoniae
MKKKILASLLLSTVMVSQVAVLTTAHAETTDDKIAAQDNKISNLTAQQQEAQKQVDQIQEQVSAIQAEQSNLQAENDRLQAESKKLEGEITELSKNIVSRNQSLEKQARSAQTNGAVTSYINTIVNSKSITEAISRVAAMSEIVSANNKMLEQQKADKKAISEKQVANNDAINTVIANQQKLADDAQALTTKQAELKAAELSLAAEKATAEGEKASLLEQKAAAEAEARAAAVAEAAYKEKRASQQQSVLASANTNLTAQVQAVSESAAAPVRAKVRPTYSTNASSYPIGECTWGVKTLAPWAGDYWGNGAQWATSAAAAGFRTGSTPQVGAIACWNDGGYGHVAVVTAVESTTRIQVSESNYAGNRTIGNHRGWFNPTTTSEGFVTYIYAD

SEQ ID NO: 276 - protein, 276 aa, Streptococcus pneumoniae
MTSMRKKTIGEVLRLARINQGLSLDELQKKTEIQLDMLEAMEADDFDQLPSPFYTRSFLKKYAWAVELDDQIVLDAYDSGSMITYEEVDVDEDELTGRRRSSKKKKKKTSFLPLFYFILFALSILIFVTYYVWNYIQTQPEEPSLSNYSVVQSTSSTSSVPHSSSSSSSSIESAISVSGEGNHVEIAYKTSKETVKLQLAVSDVTSWVSVSESELEGGVTLSPKKKSAEATVATKSPVTITLGVVKGVDLTVDNQTVDLSKLTAQTGQITVTFTKN

SEQ ID NO: 277 - protein, 122 aa, Streptococcus pneumoniae
MEYKLFEEFITLQALFKELGITHSGGAIKSFLSEHSVYFNRELESRRGKKLRIGDKVDIPDMNIDILLTQPTSEEQDEYQADKVEKERIAKLVKKMNKGVKKDKSKPASSPKSQQAPRFPGR

SEQ ID NO: 278 - protein, 189 aa, Streptococcus pneumoniae
MTKLLVGLGNPGDKYFETKHNVGFMLIDQLAKKQNVTFTHDKIFQADLASFFLNGEKIYLVKPTTFMNESGKAVHALLTYYGLDIDDLLIIYDDLDMEVGKIRLRAKGSAGGHNGIKSIIQHIGTQVFNRVKIGIGRPKNGMSVVHHVLSKFDRDDYIGILQSVDKVDDSVNYYLQEKNFEKTMQRYNG

SEQ ID NO: 279 - protein, 88 aa, Streptococcus pneumoniae
MRLDKYLKVSRIIKRRTVAKEVADKGRIKVNGILAKSSTDLKVNDQVEIRFGNKLLLVKVLEMKDSTKKEDAAGMYEIISETRVEENV

SEQ ID NO: 280 - protein, 122 aa, Streptococcus pneumoniae
MSKNIVQLNNSFIQNEYQRRRYLMKERQKRNRFMGGVLILIMLLFILPTFNLAQSYQQLLQRRQQLADLQTQYQTLSDEKDKETAFATKLKDEDYAAKYTRAKYYYSKSREKVYTIPDLLQR

SEQ ID NO: 281 - protein, 422 aa, Streptococcus pneumoniae
MRKFLIILLLPSFLTISKVVSTEKEVVYTSKEIYYLSQSDFGIYFREKLSSPMVYGEVPVYANEDLVVESGKLTPKTSFQITEWRLNKQGIPVFKLSNHQFIAADKRFLYDQSEVTPTIKKVWLESDFKLYNSPYDLKEVKSSLSAYSQVSIDKTMFVEGREFLHIDQAGWVAKESTSEEDNRMSKVQEMLSEKYQKDSFSIYVKQLTTGKEAGINQDEKMYAASVLKLSYLYYTQEKINEGLYQLDTTVKYVSAVNDFPGSYKPEGSGSLPKKEDNKEYSLKDLITKVSKESDNVAHNLLGYYISNQSDATFKSKMSAIMGDDWDPKEKLISSKMAGKFMEAIYNQNGFVLESLTKTDFDSQRIAKGVSVKVAHKIGDADEFKHDTGVVYADSPFILSIFTKNSDYDTISKIAKDVYEVLK

SEQ ID NO: 282 - DNA, 4893 bp, Streptococcus pneumoniae
actttttaatgagagtttgatcctggctcaggacgaacgctggcggcgtgcctaatacatgcaagtagaacgctgaaggaggagcttgcttctctggatgagttgcgaacgggtgagtaacgcgtaggtaacctgcctggtagcgggggataactattggaaacgatagctaataccgcataagagtagatgttgcatgacatttgcttaaaaggtgcacttgcatcactaccagatggacctgcgttgtattagctagttggtggggtaacggctcaccaaggcgacgatacatagccgacctgagagggtgatcggccacactgggactgagacacggcccagactcctacgggaggcagcagtagggaatcttcggcaatggacggaagtctgaccgagcaacgccgcgtgagtgaagaaggttttcggatcgtaaagctctgttgtaagagaagaacgagtgtgagagtggaaagttcacactgtgacggtatcttaccagaaagggacggctaactacgtgccagcagccgcggtaatacgtaggtcccgagcgttgtccggatttattgggcgtaaagcgagcgcaggcggttagataagtctgaagttaaaggctgtggcttaaccatagtaggctttggaaactgtttaacttgagtgcaagaggggagagtggaattccatgtgtagcggtgaaatgcgtagatatatggaggaacaccggtggcgaaagcggctctctggcttgtaactgacgctgaggctcgaaagcgtggggagcaaacaggattagataccctggtagtccacgctgtaaacgatgagtgctaggtgttagaccctttccggggtttagtgccgtagctaacgcattaagcactccgcctggggagtacgaccgcaaggttgaaactcaaaggaattgacgggggcccgcacaagcggtggagcatgtggtttaattcgaagcaacgcgaagaaccttaccaggtcttgacatccctctgaccgctctagagatagagctttccttcgggacagaggtgacaggtggtgcatggttgtcgtcagctcgtgtcgtgagatgttgggttaagtcccgcaacgagcgcaacccctattgttagttgccatcatttagttgggcactctagcgagactgccggtaataaaccggaggaaggtggggatgacgtcaaatcatcatgccccttatgacctgggctacacacgtgctacaatggctggtacaacgagtcgcaagccggtgacggcaagctaatctcttaaagccagtctcagttcggattgtaggctgcaactcgcctacatgaagtcggaatcgctagtaatcgcggatcagcacgccgcggtgaatacgttcccgggccttgtacacaccgcccgtcacaccacgagagtttgtaacacccgaagtcggtgaggtaaccgtaaggagccagccgcctaaggtgggatagatgattggggtgaagtcgtaacaaggtagccgtatcggaaggtgcggctggatcacctcctttctaaggataaggaactgcgcattggtcttgtttagtcttgagaggtcttgtggggccttagctcagctgggagagcgcctgctttgcacgcaggaggtcagcggttcgatcccgctaggctccattggtgagagatcaccaagtaatgcacattgaaaattgaatatctatatcaaatagtaacaagaaaataaaccgaaaacgctgtagtattaataagagtttatgactgaaaggtcagaaaataaggttaagttaataagggcgcacggtggatgccttggcactaggagccgacgaaggacgtgacaaacgacgatatgccttgggtagctgtaagtaagcgatgatccagggatttccgaatgggggaacccaacaggtaatacctgttacccacatctgttaaggatgtgaggaggaagacgcagtgaactgaaacatctaagtagctgcaggaagagaaagcaaaagcgattgccttagtagcggcgagcgaaacggcagaagggcaaaccgaagagtttactcttcggggttgtaggactgcaatgtggactcaaagattatagaagaatgatttgggaagatcagccaaagagagtaatagcctcgtatttaaaatagtctttgtacttagcagtatcctgagtacggcgggacacgtgaaatcccgtcggaatctgggaggaccatctcccaaccctaaatactccctagtgaccgatagtgaaccagtaccgtgagggaaaggtgaaaagcaccccgggaggggagtgaaatagaacctgaaaccgtgtgcctacaacaagttcgagcccgttaatgggtgagagcgtgccttttgtagaatgaaccggcgagttacgttatgatgcgaggttaagttgaagagacggagccgtagggaaaccgagtctgaatagggcgccttagtatcatgacgtagacccgaaaccatgtgacctacccatgagcaggttgaaggtgcggtaagacgcactggaggaccgaaccagggcacgttgaaaagtgcttggatgacttgtgggtagcggagaaattccaaacgaacttggagatagctggttctctccgaaatagctttagggctagcgtcgacattagagattcttggaggtagagcactgtttgggtgaggggtccatcccggattaccaatctcagataaactccgaatgccaatgaattatggtcggcagtcagactgcgagtgctaagatccgtagtcgaaagggaaacagcccagaccaccagctaaggtcccaaaataattgttaagtggaaaaggatgtggggttgcacagacaactaggatgttagcttagaagcagctattcattcaaagagtgcgtaatagctcactagtcgagtgaccctgcgccgaaaatgtaccggggctaaaacaatttaccgaagctgtggatacctttataggtatggtaggagagcgttctatgtgtgatgaaggtataccgtgaggagtgctggaacgcatagaagtgagaatgccggtatgagtagcgaaagacaggtgagaatcctgtccaccgtaagactaaggtttccaggggaaggctcgtccgccctgggttagtcgggacctaaggagagaccgaaaggtgtatccgatggacaacaggttgatattcctgtactagagtatgtagtgatggagggacgcagtaggctaactaaagcagacgattggaagagtctgtctaagcagtgaggtgtgaattgagtcaaatgcttaattctataacattgagctgtgatggggagcgaagtttagtagcgaagttagtgacgtcacactgccaagaaaagcttctagcgtttaaacatactctacccgtaccgcaaaccgacacaggtagtcgaggcgagtagcctcaggtgagcgagagaactctcgttaaggaactcggcaaaatgaccccgtaacttcgggagaaggggtgctgacttaaagtcagccgcagtgaataggcccaagcaactgtttatcaaaaacacagctctctgctaaatcgtaagatgatgtatagggggtgacgcctgcccggtgctggaaggttaagaggagtgcttagcgtaagcgaaggtatgaattgaagccccagtaaacggcggccgtaactataacggtcctaaggtagcgaaattccttgtcgggtaagttccgacccgcacgaaaggcgtaatgatttgggcactgtctcaacgagagactcggtgaaattttagtacctgtgaagatgcaggttacccgcgacaggacggaaagaccccatggagctttactgcagtttgatattgagtgtctgtaccacatgtacaggataggtaggagtctaagagatcgggacgccagtttcgaaggagacgctgttgggatactacccttgtgttatggccactctaacccagataggtgatccctatcggagacagtgtctgacgggcagtttgactggggcggtcgcctcctaaaaggtaacggaggcgcccaaaggttccctcagaatggttggaaatcattcgcagagtgtaaaggtataagggagcttgactgcgagagctacaactcgagcagggacgaaagtcgggcttagtgatccggtggttccgtatggaagggccatcgctcaacggataaaagctaccctggggataacaggcttatctcccccaagagttcacatcgacggggaggtttggcacctcgatgtcggctcgtcgcatcctggggctgtagtcggtcccaagggttgggctgttcgcccattaaagcggcacgcgagctgggttcagaacgtcgtgagacagttcggtccctatccgtcgcgggcgtaggaaatttgagaggatctgctcctagtacgagaggaccagagtggacttaccgctggtgtaccagttgtcttgccaaaggcatcgctgggtagctatgtagggaagggataaacgctgaaagcatctaagtgtgaaacccacctcaagatgagatttcccatgattatatatcagtaagagccctgagagatgatcaggtagataggttagaagtggaagtgtggcgacacatgtagcggactaatactaatagctcgaggacttatccaaagtaactgagaatatgaaagcgaacggttttcttaaattgaatagatattcaattttgagtaggtattactcagagttaagtgacgatagcctaggagatacacctgtacccatgccgaacacagaagttaagccctagaacgccggaagtagttgggggttgccccctgtgagatagggaagtcgcttagct

SEQ ID NO: 283 - protein, 112 aa, Streptococcus pneumoniae
MVAGLTNGELIAPMTYEETMTSDFFEAWFQNFLLPTLNTPSVIIMDNVRFHRMGKLELLCEEFGHKLLPLPPYSPEYNPIEKTWAHIKKHLKKVLPSCNTFYEAFLSCSCFN

SEQ ID NO: 284 - protein, 155 aa, Streptococcus pneumoniae
MYYTLEEKEVFMREALREAEIALEHDEIPIGCVIVKDGEIIGRGHNAREELQRAVMHAEIMAIEDANLSEESWRLLDCTLFVTIEPCVMCSGAIGLARIPNVVYGAKNQKFGAAGSLYNILTDERLNHRVEVEIGILEDECAAIMQDFFRNRRKK

SEQ ID NO: 285 - protein, 147 aa, Streptococcus pneumoniae
MKIRGFELVSSFTDENLLPKRETAHAAGYDLKVAVRTVVAPGEIVLVPTGVKAYMQPTEVLYLYDRSSNPRKKGLVLINSVGVIDGDYYGNPGNEGHIFAQMKNITDQEVVLEVGERIVQAVFATFLIADGDAADGVRTGGFGSTGH

SEQ ID NO: 286 - protein, 165 aa, Streptococcus pneumoniae
MSYFEQFMQANQAYVALHGQLNLPLKPKTRVAIVTCMDSRLHVAQALGLALGDAHILRNAGGRVTEDMIRSLVISQQQMGTREIVVLHHTDCGAQTFENEPFQEYLKEELGVDVSDQDFLPFQDIEESVREDMQLLIESPLIPDDVIISGAIYNVDTGSMTVVEL

SEQ ID NO: 287 - protein, 108 aa, Streptococcus pneumoniae
MDSNYFSDDLAFHSFSMREDTTGEVLAITNNGQENHLVKMAFLELKNTEKPAKTRFASHGWSFSATSPLPSNRNEPLPKQINCWTTRAGPRRTGKCLVNYICEKNKSC

SEQ ID NO: 288 - protein, 330 aa, Streptococcus pneumoniae
MKKIAVDAMGGDYAPQAIVEGVNQALSDFSDIEVQLYGDEAKIKQYLTATERVSIIHTDEKIDSDDEPTRAIRNKKNASMVLAAKAVKDGEADAVLSAGNTGALLAAGFFIVGRIKNIDRPGLMSTLPTVDGKGFDMLDLGANAENTAQHLHQYAVLGSFYAKNVRGIAQPRVGLLNNGTESSKGDPLRKETYELLAADESLNFIGNVEARDLMNGVADVVVADGFTGNAVLKSIEGTAMGIMGLLKTAITGGGLRAKLGALLLKDSLSGLKKQLNYSDVGGAVLFGVKAPVVKTHGSSDAKAVYSTIRQIRTMLETDVVAQTAREFSGE

SEQ ID NO: 289 - protein, 76 aa, Streptococcus pneumoniae
MNTKTMSQFEIMDTEMLACVEGGGCNWGDFAKAGVGGGAARGLQLGIKTRTWQGAATGAVGGAILGGVAYAATCWW

SEQ ID NO: 290 - protein, 480 aa, Streptococcus pneumoniae
MTYEVKSLNEECGVFGIWGHPDAAKLTYFGLHSLQHRGQEGAGILSNDQGQLKRHRDMGLLSEVFRNPANLDKLTGAGAIGHVRYATAGEASVDNIQPFLFRFHDMQFGLAHNGNLTNAASLKKELEQRGAIFSATSDSEILAHLIRRSHNPSLMGKIKEALSLVKGGFAYILLFEDKLIAALDPNGFRPLSIGKMANGAVVVSSETCAFEVIGAEWIRDLKPGEIVIIDDEGIQYDSYTDDTQLAVCSMEYIYFARPDSNIHGVNVHTARKRMGAQLAREFKHEADIVVGVPNSSLSAAMGFAEESGLPNEMGLIKNQYTQRTFIQPTQELREQGVRMKLSAVSGVVKGKRVVMVDDSIVRGTTSRRIVQLLKEAGATEVHVAIGSPALAYPCFYGIDIQTRQELIAANHTVEETRQIIGADSLTYLSIDGLIESIGIETDAPNGGLCVAYFDGDYPTPLYDYEEDYRRSLEEKTSFYK

SEQ ID NO: 291 - protein, 181 aa, Streptococcus pneumoniae
MKKIAVFASGNGSNFQVIAEEFPVEFVFSDHRDAYVLERAKQLGVLSYAFELKEFESKADYEAALVELLEEHQIDLVCLAGYMKIVGPTLLSAYEGRIVNIHPAYLPEFPGAHGIEDAWNAGVGQSGVTIHWVDSGVDTGQVIKQVRVPRLADDTIDRFEARIHEAEYRLYPEVVKALFTD

SEQ ID NO: 292 - protein, 515 aa, Streptococcus pneumoniae
MTKRVLISVSDKAGIVEFAQELKKLGWEIISTGGTKVALDNAGVDTIAIDDVTGFPEMMDGRVKTLHPNIHGGLLARRDLDSHLEAAKDNKIELIDLVVVNLYPFKETILKPDVTYADAVENIDIGGPSMLRSAAKNHASVTVVVDPADYAVVLDELAANGETSYETRQRLAAKVFRHTAAYDALIAEYFTAQVGESKPEKLTLTYDLKQPMRYGENPQQDADFYQKALPTDYSIASAKQLNGKELSFNNIRDADAAIRIIRDFKDSPTVVALKHMNPCGIGQADDIETAWDYAYESDPVSIFGGIVVLNREVDAATAEKMHGVFLEIIIAPSYTDEALAILINKKKNLRILALPFNAQEASEVEAEYTGVVGGLLVQNQDVVKESPADWQVVTKRQPTETEATALEFAWKAIKYVKSNGIIVTNDHMTLGVGPGQTNRVASVRLAIDQAKDRLDGAVLASDAFFPFADNVEEIAKAGIKAIIQPGGSVRDQESIEAADKYGLTMVFTGVRHFRH

SEQ ID NO: 293 - protein, 162 aa, Streptococcus pneumoniae
MKPVISIIMGSKSDWATMQKTAEVLDRFGVAYEKKVVSAHRTPDLMFKHAEEARSRGIKIIIAGAGGAAHLPGMVAAKTTLPVIGVPVKSRALSGVDSLYSIVQMPGGVPVATMAIGEAGATNAALFALRLLSVEDKSIADALANFAEEQGKIAEESSNELI

SEQ ID NO: 294 - protein, 1312 aa, Streptococcus pneumoniae
MKHEKQQRFSIRKYAVGAASVLIGFAFQAQTVAADGVTPTTTENQPTIHTVSDSPQSSENRTEETPKAVLQPEAPKTVETETPATDKVASLPKTEEKPQEEVSSTPSDKAEVVTPTSAEKETANKKAEEASPKKEEAKEVDSKESNTDKTDKDKPAKKDEAKAEADKPATEAGKERAATVNEKLAKKKIVSIDAGRKYFSPEQLKEIIDKAKHYGYTDLHLLVGNDGLRFMLDDMSITANGKTYASDDVKRAIEKGTNDYYNDPNGNHLTESQMTDLINYAKDKGIGLIPTVNSPGHMDAILNAMKELGIQNPNFSYFGKKSARTVDLDNEQAVAFTKALIDKYAAYFAKKTEIFNIGLDEYANDATDAKGWSVLQADKYYPNEGYPVKGYEKFIAYANDLARIVKSHGLKPMAFNDGIYYNSDTSFGSFDKDIIVSMWTGGWGGYDVASSKLLAEKGHQILNTNDAWYYVLGRNADGQGWYNLDQGLNGIKNTPITSVPKTEGADIPIIGGMVAAWADTPSARYSPSRLFKLMRHFANANAEYFAADYESAEQALNEVPKDLNRYTAESVTAVKEAEKAIRSLDSNLSRAQQDTIDQAIAKLQETVNNLTLTPEAQKEEEAKREVEKLAKNKVISIDAGRKYFTLNQLKRIVDKASELGYSDVHLLLGNDGLRFLLDDMTITANGKTYASDDVKKAIIEGTKAYYDDPNGTALTQAEVTELIEYAKSKDIGLIPAINSPGHMDAMLVAMEKLGIKNPQAHFDKVSKTTMDLKNEEAMNFVKALIGKYMDFFAGKTKIFNFGTDEYANDATSAQGWYYLKWYQLYGKFAEYANTLAAMAKERGLQPMAFNDGFYYEDKDDVQFDKDVLISYWSKGWWGYNLASPQYLASKGYKFLNTNGDWYYILGQKPEDGGGFLKKAIENTGKTPFNQLASTKYPEVDLPTVGSMLSIWADRPSAEYKEEEIFELMTAFADHNKDYFRANYNALREELAKIPTNLEGYSKESLEALDAAKTALNYNLNRNKQAELDTLVANLKAALQGLKPAVTHSGSLDENEVAANVETRPELITRTEEIPFEVIKKENPNLPAGQENIITAGVKGERTHYISVLTENGKTTETVLDSQVTKEVINQVVEVGAPVTHKGDESGLAPTTEVKPRLDIQEEEIPFTTVTCENPLLLKGKTQVITKGVNGHRSNFYSVSTSADGKEVKTLVNSVVAQEAVTQIVEVGTMVTHVGDENGQAAIAEEKPKLEIPSQPAPSTAPAEESKVLPQDPAPVVTEKKLPETGTHDSAGLVVAGLMSTLAAYGLTKRKED

SEQ ID NO: 295 - protein, 659 aa, Streptococcus pneumoniae
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQKPLPSVIAENPSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSAEGMVVEQSPRAGEKVDLNKTRVKISIYKPKTTSATP

SEQ ID NO: 296 - protein, 191 aa, Streptococcus pneumoniae
MKQKQPIVSRTKQHTFEELIQDQKLERLAKLSPDLVGRYGFTASCASSFANLIKEAYGGKNLNVVYASRMLALWNIACSCYHKADGYSLADALFSDKKICLDSYYYHKNTSNTITSDVIKDVYDNYNNYMVLTREATPEYIYVVQTEMPKDSDLYFYIREVLGLSFSTMHYAFLVKVLAGALARKYKPYRN

SEQ ID NO: 297 - protein, 193 aa, Streptococcus pneumoniae
MKLLEERILKDGHILGDNILKVDSFLTHQVDFSLMREIGKVFAEKFATTGITKVVTIEASGIAPAVFTAEALNVPMIFAKKAKNITMNEGILTAQVYSFTKQVTSTVSIAEKFLSPEDKVLIIDDFLANGQAAKGLIQIIEQAGATVQAIGIVIEKSFQDGRDLLEKAGYPVLSLARLDCFENGQVVFKEADL

SEQ ID NO: 298 - protein, 254 aa, Streptococcus pneumoniae
MELHFNLELVETYKSNSQKARILTEDWVYRQSYCPNCGNNPLNHFENNRPVADFYCNHCSEEFELKSKKGNFSSTINDGAYATMMKRVQADNNPNFFFLTYTKNFEVNNFLVLPKQFVTPKSIIQRKPLAPTARRAGWIGCNIDLSQVPSKGRIFLVQDGQVRDPEKVTKEFKQGLFLRKSSLSSRGWTIEILNCIDKIEGSEFTLEDMYRFESDLKNIFVKNNHIKEKIRQQLQILRDKEIIEFKGRGKYRKL

SEQ ID NO: 299 - protein, 345 aa, Streptococcus pneumoniae
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDRQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 300 - protein, 354 aa, Streptococcus pneumoniae
MTTLFSKIKEVTELAAVSGHEAPVRAYLREKLTPHVDEVVTDGLGGIFGIKHSEAVDAPRVLVASHMDEVGFMVSEIKPDGTFRVVEIGGWNPMVVSSQRFKLLTRDGHEIPVISGSVPPHLTRGKGGPTMPAIADIVFDGGFADKAEAESFGIRPGDTIVPDSSAILTANEKNIISKAWDNRYGVLMVSELAEALSGQKLGNELYLGSNVQEEVGLRGAHTSTTKFDPEVFLAVDCSPAGDVYGGQGKIGDGTLIRFYDPGHLLLPGMKDFLLTTAEEAGIKYQYYCGKGGTDAGAAHLKNGGVPSTTIGVCARYIHSHQTLYAMDDFLEAQAFLQALVKKLDRSTVDLIKHY

SEQ ID NO: 301 - protein, 419 aa, Streptococcus pneumoniae
MEWYKKIGLLATTGLALFGLGACSNYGKSADGTVTIEYFNQKKEMTKTLEEITRDFEKENPKIKVKVVNVPNAGEVLKTRVLAGDVPDVVNIYPQSIELQEWAKAGVFEDLSNKDYLKRVKNGYAEKYAVNEKVYNVPFTANAYGIYYNKDKFEELGLKVPETWDEFEQLVKDIVAKGQTPFGIAGADAWTLNGYNQLAFATATGGGKEANQYLRYSQPNAIKLSDPIMKDDIKVMDILRINGSKQKNWEGAGYTDVIGAFARGDVLMTPNGSWAITAINEQKPNFKIGTFMIPGKEKGQSLTVGAGDLAWSISATTKHPKEANAFVEYMTRPEVMQKYYDVDGSPTAIEGVKQAGEDSPLAGMTEYAFTDRHLVWLQQYWTSEADFHTLTMNYVLTGDKQGMVNDLNAFFNPMKADVD

SEQ ID NO: 302 - DNA, 4894 bp, Streptococcus pneumoniae
gctaagcgacttccctatctcacagggggcaacccccaactacttccggcgttctagggcttaacttctgtgttcggcatgggtacaggtgtatctcctaggctatcgtcacttaactctgagtaatacctactcaaaattgaatatctattcaatttaagaaaaccgttcgctttcatattctcagttactttggataagtcctcgagctattagtattagtccgctacatgtgtcgccacacttccacttctaacctatctacctgatcatctctcagggctcttactgatatataatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacagcgtctccttcgaaactggcgtcccgatctcttagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgactttaagtcagcaccccttctcccgaagttacggggtcattttgccgagttccttaacgagagttctctcgctcacctgaggctactcgcctcgactacctgtgtcggtttgcggtacgggtagagtatgtttaaacgctagaagcttttcttggcagtgtgacgtcactaacttcgctactaaacttcgctccccatcacagctcaatgttatagaattaagcatttgactcaattcacacctcactgcttagacagactcttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtataccttcatcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaaggcgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaagtacaaagactattttaaatacgaggctattactctctttggctgatcttcccaaatcattcttctataatctttgagtccacattgcagtcctacaaccccgaagagtaaactcttcggtttgcccttctgccgtttcgctcgccgctactaaggcaatcgcttttgctttctcttcctgcagctacttagatgtttcagttcactgcgtcttcctcctcacatccttaacagatgtgggtaacaggtattacctgttgggttcccccattcggaaatccctggatcatcgcttacttacagctacccaaggcatatcgtcgtttgtcacgtccttcgtcggctcctagtgccaaggcatccaccgtgcgcccttattaacttaaccttattttctgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctccttacggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaagctctatctctagagcggtcagagggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctacggcactaaaccccggaaagggtctaacacctagcactcatcgtttacagcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcctactatggttaagccacagcctttaacttcagacttatctaaccgcctgcgctcgctttacgcccaataaatccggacaacgctcgggacctacgtattaccgcggctgctggcacgtagttagccgtccctttctggtaagataccgtcacagtgtgaactttccactctcacactcgttcttctcttacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagccgttaccccaccaactagctaatacaacgcaggtccatctggtagtgatgcaagtgcaccttttaagcaaatgtcatgcaacatctactcttatgcggtattagctatcgtttccaatagttatcccccgctaccaggcaggttacctacgcgttactcacccgttcgcaactcatccagagaagcaagctcctccttcagcgttctacttgcatgtattaggcacgccgccagcgttcgtcctgagccaggatcaaactctcattaaaaagttt

SEQ ID NO: 303 - protein, 105 aa, Streptococcus pneumoniae
MIQPASLEELASLVEKAGKKVFIFVADWCSDCRYIYPALPEIEETNPEFTFIRMDRDQYMDLAKLWDVYGIPSLVVLEKDKEIGRFVNRDRKSKQQINDFLAGLK

SEQ ID NO: 304 - protein, 99 aa, Streptococcus pneumoniae
MNGMKAKKMWMAGLALLGIGSLALATKKVADDRKLMKTQEELTEIVRDHFSDMGEIATLYVQVYESSLESLVGGVIFEDGRHYTFVYENEDLVYEEEVL

SEQ ID NO: 305 - protein, 471 aa, Streptococcus pneumoniae
MANKAVNDFILAMNYDKKKLLTHQGESIENRFIKEGNQLPDEFVVIERKKRSLSTNTSDISVTATNDSRLYPGALLVVDETLLENNPTLLAVDRAPMTYSIDLPGLASSDSFLQVEDPSNSSVRGAVNDLLAKWHQDYGQVNNVPARMQYEKITAHSMEQLKVKFGSDFEKTGNSLDIDFNSVHSGEKQIQIVNFKQIYYTVSVDAVKNPGDVFQDTVTVEDLKQRGISAERPLVYISSVAYGRQVYLKLETTSKSDEVEAAFEALIKGVKVAPQTEWKQILDNTEVKAVILGGDPSSGARVVTGKVDMVEDLIQEGSRFTADHPGLPISYTTSFLRDNVVATFQNSTDYVETKVTAYRNGDLLLDHSGAYVAQYYITWNELSYDHQGKEVLTPKAWDRNGQDLTAHFTTSIPLKGNVRNLSVKIRECTGLAWEWWRTVYEKTDLPLVRKRTISIWGTTLYPQVEDKVEND

SEQ ID NO: 306 - protein, 318 aa, Streptococcus pneumoniae
MEINVSKLRTDLPQVGVQPYRQVHAHSTGNPHSTVQNEADYHWRKDPELGFFSHIVGNGCIMQVGPVDNGAWDVGGGWNAETYAAVELIESHSTKEEFMTDYRLYIELLRNLADEAGLPKTLDTGSLAGIKTHEYCTNNQPNNHSDHVDPYPYLAKWGISREQFKHDIENGLTIETGWQKNDTGYWYVHSDGSYPKDKFEKINGTWYYFDSSGYMLADRWRKHTDGNWYWFDNSGEMATGWKKIADKWYYFNEEGAMKTGWVKYKDTWYYLDAKEGAMVSNAFIQSADGTGWYYLKPDGTLADKPEFTVEPDGLITVK

SEQ ID NO: 307 - protein, 56 aa, Streptococcus pneumoniae
MRKKRGIKKLVTFALLGVFMFSNTIPYQQFIQKNKQLEIRVQSQKKSNGLDVGKAD

SEQ ID NO: 308 - protein, 74 aa, Streptococcus pneumoniae
MTNFNSNEKFCGKSLKSLSADEMSLIYGASDGAEPRWTPTPIILKSAAASSKVCISAAVSGIGGLVSYNNDCLG

SEQ ID NO: 309 - protein, 62 aa, Streptococcus pneumoniae
MKNDFVIGKSLKELSLEEMQLVYGGTDGADPRSTIICSATLSFIASYLGSAQTRCGKDNKKK

SEQ ID NO: 310 - protein, 467 aa, Streptococcus pneumoniae
MKKKYWTLAILFFCLFNNSVTAQEIPKNLDGNITHTQTSESFSESDEKQVDYSNKNQEEVDQNKFRIQIDKTELFVTTDKHLEKNCCKLELEPQINNDIVNSESNNLLGEDNLDNKIKENVSHLDNRGGNIEHDKDNLESSIVRKYEWDIDKVTGGGESYKLYSKSNSKVSIAILDSGVDLQNTGLLKNLSNHSKNYVPNKGYLGKEEGEEGIISDIQDRLGHGTAVVAQIVGDDNINGVNPHVNINVYRIFGKSSASPDWIVKAIFDAVDDGNDIINLSTGQYLMIDGEYEDGTNDFETFLKYKKAIDYANQKGVIIVAALGNDSLNVSNQSDLLKLISSRKKVRKPGLVVDVPSYFSSTISVGGIDRLGNLSDFSNKGDSDAIYAPAGSTLSLSELGLNNFINAEKYKEDWIFSATLGGYTYLYGNSFAAPKVSGAIAMIIDKYKLKDQPYNYMFVKKFWKKHYQ

SEQ ID NO: 311 - protein, 103 aa, Streptococcus pneumoniae
MLNIPNVLRYDLNMLQLEYKNEQSWDSFIDNVNLIELEERIQTTIGIKQINTHNIITIAREGYSQNYLPNTSENTYNSLQVSLVGVLLLFISMVNILWAKKSK

SEQ ID NO: 312 - protein, 308 aa, Streptococcus pneumoniae
MKKDELFEGFYLIKSADLRQTRAGKNYLAFTFQDDSGEIDGKLWDAQPHNIEAFTAGKVVHMKGRREVYNNTPQVNQITLRLPQAGEPNDPADFKVKSPVDVKEIRDYMSQMIFKIENPVWQRIVRNLYTKYDKEFYSYPAAKTNHHAFETGLAYHTATMVRLADAISEVYPQLNKSLLYAGIMLHDLAKVIELTGPDQTEYTVRGNLLGHIALIDSEITKTVMELGIDDTKEEVVLLRHVILSHHGLLEYGSPVRPRIMEAEIIHMIDNLDASMMMMSTALALVDKGEMTNKIFAMDNRSFYKPDLD

SEQ ID NO: 313 - protein, 186 aa, Streptococcus pneumoniae
MKEKISQVIVVEGRDDTVNLKRYFDVETYETRGSAINAQDIERIQRLHQRHGVIVFTDPDFNGERIRRMIMMVIPTVQHAFLKRDEAVPKSKTKGRSLGIEHASYEDLKTALAQVTEQFEHESQFDISRSDLIRLGFLAGADSRKRREYLGETLRIGYSNGKQLLKRLELFGVTLAEVEEAMKSYE

SEQ ID NO: 314 - protein, 257 aa, Streptococcus pneumoniae
MIFDTHTHLNVEEFAGREAEEIALAAEMGVTQMNIVGFDKPTIEHALELVDEYEQLYATIGWHPTEAGTYTEEVEAYLLDKLKHSKVVALGEIGLDYHWMTAPKEVQEQVFRRQIQLSKDLDLPFVVHTRDALEDTYEIIKSEGVGPRGGIMHSFSGTLEWAEKFVDLGMTISFSGVVTFKKATDLQEAAKELPLDKMLVETDAPYLAPVPKRGRENKTAYTRYVVDFIADLRGMTTEELAVATTANAERIFGLDSK

SEQ ID NO: 315 - protein, 404 aa, Streptococcus pneumoniae
MKEYNKSSKLEHVAYDIRGPVLEEAMRMRANGEKILRLNTGNPAEFGFTAPDEVIHDLIMNARDSEGYSDSKGIFSARKAIMQYCQLKKFPNVDTDDIYLGNGVSELIVMSMQGLLDNGDEVLVPMPDYPLWTAAVSLAGGNAVHYICDEAVEWYPDIDDIKSKITSNTKAIVLINPNNPTGALYPKELLLEIIEIARQNDLIIFADEIYDRMVMDGHVHTPVASLAPDVFCVSMNGLSKSHRIAGFRVGWMVLSGPKTHVKGYIEGLNMLSNMRLCSNVLAQQVVQTSLGGHQSVDELLLPGGRIYEQRNFIYNAIQDIPGLSAVKPKAGLYIFPKIDRNMYRIDDDEQFVLDFLKQEKVLLVHGRGFNWQEPDHFRIVYLPRVDELAQIQEKMTRFLKQYRR

SEQ ID NO: 316 - protein, 462 aa, Streptococcus pneumoniae
MEVKAVFFDIDGTLVNNRKSVLKSTKDAIKIVKEQGVLVGVATGRGPFFVKELMDDLDLDFAVTYNGQYIFSKDRVLFTSPISKLHLRHLISYAKKEGTEIALGTKDAMLGSKIMSFGLGSFSQRISRFVPSVLTRTVSQSFNRMVSKVVPQKEEDLLHLMNQPIYQVLMLMTPEESEKAAADFEDLKLTRSNPFASDVINQGNSKLEGIRRVGKEYGFDLNQVMAFGDSDNDLEMLAGVGMSVAMGNGSSSVKEAAKHITTSNQQDGIHKALEHFGVLSSEKVFVSRDYHFNKVKTFHHMMDERTQEEPRAWDLEGATHRAGFKIEELVEFVRAASPSEEDFGQAVSQLHQALDKAADKVAKKTPAQQDLIGQVDALIDTLYFTYGSFVLMGVDPERIFDIVHQANMGKIFPDGKAHFDPVTHKILKPDNWEEKYAPEPAIKKELQRQLKAYERHKERNKS

SEQ ID NO: 317 - DNA, 4843 bp, Streptococcus pneumoniae
gctaagcgacttccctatctcacagggggcaacccccaactacttccggcgttctagggcttaacttctgtgttcggcatgggtacaggtgtatctcctaggctatcgtcacttaactctgagtaatacctactcaaaattgaatatctattcaatttaagaaaaccgttcgctttcatattctcagttactttggataagtcctcgagctattagtattagtccgctacatgtgtcgccacacttccacttctaacctatctacctgatcatctctcagggctcttactgatatataatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacagcgtctccttcgaaactggcgtcccgatctcttagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgactttaagtcagcaccccttctcccgaagttacggggtcattttgccgagttccttaacgagagttctctcgctcacctgaggctactcgcctcgactacctgtgtcggtttgcggtacgggtagagtatgtttaaacgctagaagcttttcttggcagtgtgacgtcactaacttcgctactaaacttcgctccccatcacagctcaatgttatagaattaagcatttgactcaattcacacctcactgcttagacagactcttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtataccttcatcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaaggcgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaagtacaaagactattttaaatacgaggctattactctctttggctgatcttcccaaatcattcttctataatctttgagtccacattgcagtcctacaaccccgaagagtaaactcttcggtttgcccttctgccgtttcgctcgccgctactaaggcaatcgcttttgctttctcttcctgcagctacttagatgtttcagttcactgcgtcttcctcctcacatccttaacagatgtgggtaacaggtattacctgttgggttcccccattcggaaatccctggatcatcgcttacttacagctacccaaggcatatcgtcgtttgtcacgtccttcgtcggctcctagtgccaaggcatccaccgtgcgcccttattaacttaaccttattttctgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctccttacggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaagctctatctctagagcggtcagagggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctacggcactaaaccccggaaagggtctaacacctagcactcatcgtttacagcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcctactatggttaagccacagcctttaacttcagacttatctaaccgcctgcgctcgctttacgcccaataaatccggacaacgctcgggacctacgtattaccgcggctgctggcacgtagttagccgtccctttctggtaagataccgtcacagtgtgaactttccactctcacactcgttcttctcttacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagccgttaccccaccaactagctaatacaacgcaggtccatctggtagtgatgcaagtgcaccttttaagcaaatgtcatgcaacatctactcttatgcggtattagctatcgtttccaatagttatcccccgctaccaggcaggttacctacgcgttactcacccgttcgcaactcatccagagaagcaagctcctccttcagcgttctacttgcatgtattaggc

SEQ ID NO: 318 - protein, 731 aa, Streptococcus pneumoniae
MKLDKLFEKFLSLFKKETSELEDSDSTILRRSRSDRKKLAQVGPIRKFWRRYHLTKIILILGLSAGLLVGIYLFAVAKSTNVNDLQNALKTRTLIFDREEKEAGALSGQKGTYVELTDISKNLQNAVIATEDRSFYKNDGINYGRFFLAIVTAGRSGGGSTITQQLAKNAYLSQDQTVERKAKEFFLALELSKKYSKEQILTMYLNNAYFGNGVWGVEDASKKYFGVSASEVSLDQAATLAGMLKGPELYNPLNSVEDSTNRRDTVLQNMVAAGYIDKNQETKAAEVDMTSQLHDKYEGKISDYRYPSYFDAVVNEAVSKYNLTEEEIVNNGYRIYTELDQNYQANMQIVYENTSLFPRAEDGTFAQSGSVALEPKTGGVRGVVGQVADNDKTGFRNFNYATQSKRSPGSTIKPLVVYTPAVEASWALNKQLDNHTMQYDSYKVDNYAGIKTSREVPMYQALAESLNLPAVATVNDLGVDKAFEAGEKFGLNMEKVDRVLGVALGSGVETNPLQMAQAYAAFANEGLMPEAHFISRIENASGQVIASHKNSQKRVIDKSVADKMTSMMLGTFTNGTGISSSPADYVMAGKTGTTEAVFNPEYTSDQWVIGYTPDVVISHWLGFPTTDENHYLAGSTSNGAAHVFRNIANTILPYTPGSTFTVENAYKQNGIAPANTKRQVQTNDNSQTDDNLSDIRGRAQSLVDEASRAISDAKIKEKAQTIWDSIVNLFR

SEQ ID NO: 319 - protein, 112 aa, Streptococcus pneumoniae; identical to SEQ ID NO: 283

SEQ ID NO: 320 - protein, 469 aa, Streptococcus pneumoniae
MKKKLVFPNLFWWGAASSGPQTEGQYGKVHENVMDYWFKTHPEDFFDNVGPLVASNFFHTYTEDFHLMKEIGVNSFRTSIQWSRLIKNLETGEPDPKGIAFYNAIIEEAKKNQMDLVMNLHHFDLPVELLQKYGGWESKHVVELFVKFAKTAFTCFGDKVHYWTTFNEPMVIPEAGYLYAFHYPNLKGKGKEAVQVIYNLNLASAKVIQLYRSLELDGKIGIILNLTPAYPRSNSPEDLEASRFTDDFFNKVFLNPAVKGTFPERLVKQLERDGVLWSHTEKELQLMKSNTVDFLGVNYYHPKRVQAQANPEEYQTPWMPDQYFKEYEWLERRMNPYRGWEIFPKAIYDIAMIVKEEYGNIPWFISENGMGVENEARFIDENGVIDDVYRIEFYEEHLRWLHKAIEEGSHCFGYHAWTAFDCWSWNNAYKNRYGFISVDLETQKRTIKSSGRWYRKVSDNNGFEVEIEE

SEQ ID NO: 321 - protein, 136 aa, Streptococcus pneumoniae
MENLTNFYEKYRVYLTRPRLELLAVVTIVFCAVLVFFLNIPGKGVLKLDNGTIVYDGSLVRGKMNGQGTITFQNGDQYTGGFNNGAFNGKGTFQSKEGWTYEGDFVNGQAEGKGKLTTEQEVVYEGTFKQGVFQQK

SEQ ID NO: 322 - protein, 658 aa, Streptococcus pneumoniae
MSNLSVNAIRFLGIDAINKANSGHPGVVMGAAPMAYSLFTKQLHINPAQPNWINRDRFILSAGHGSMLLYALLHLSGFEDVSMDEIKSFRQWGSKTPGHPEFGHTAGIDATTGPLGQGISTATGFAQAERFLAAKYNREGYNIFDHYTYVICGDGDLMEGVSSEAASYAGLQKLDKLVVLYDSNDINLDGETKDSFTESVRDRYNAYGWHTALVENGTDLEAIHAAIETAKASGKPSLIEVKTVIGYGSPNKQGTNAVHGAPLGADETASTRQALGWDYEPFEIPEQVYADFKEHVADRGASAYQAWTKLVADYKEAHPELAAEVEAIIDGRDPVEVTPADFPALENGFSQATRNSSQDALNVVAAKLPTFLGGSADLAHSNMTYIKTDGLQDDANRLNRNIQFGVREFAMGTILNGMALHGGLRVYGGTFFVFSDYVKAAVRLSALQGLPVTYVFTHDSIAVGEDGPTHEPVEHLAGLRAMPNLNVFRPADARETQAAWYLAVTSEKTPTALVLTRQNLTVEDGTDFDKVAKGAYVVYENAADFDTILIATGSEVNLAVSAAKELASQGEKIRVVSMPSTDVFDKQDAAYKEEILPNAVRRRVAVEMGASQNWYKYVGLDGAVLGIDTFGASAPAPKVLAEYGFTVENLVKVVRNLK

SEQ ID NO: 323 - protein, 123 aa, Streptococcus pneumoniae
MKKNFRVKREKDFKAIFKEGTSFANRKFVVYQLENQKNRFRVGLSVSKKLGNAVTRNQIKRRIRHIIQNAKGSLVEDVDFVVIARKGVETLGYAEMEKNLLHVLKLSKIYREGNGSEKETKVD

SEQ ID NO: 324 - protein, 108 aa, Streptococcus pneumoniae
MKKMMTFLKKAKVKAFTLVEMLVVLLIISVLFLLFVPNLTKQKEAVNDKGKAAVVKVVESQAELYSLEKNEDASLRKLQADGRITEEQAKAYKEYNDKNGGANRKVND

SEQ ID NO: 325 - protein, 352 aa, Streptococcus pneumoniae
MKAYTYVKPGLASFVDVDKPVIRKPTDAIVRIVKTTICGTDLHIIKGDVPTCQSGTILGHEGIGIVEEVGEGVSNFKKGDKVLISCVCACGKCYYCKKGIYAHCEDEGGWIFGHLIDGMQAEYLRVPHADNTLYHTPEDLSDEALVMLSDILPTGYEIGVLKGKVEPGCSVAIIGSGPVGLAALLTAQFYSPAKLIMVDLDDNRLETALSFGATHKVNSSDPEKAIKEIYDLTDGRGVDVAIEAVGIPATFDFCQKIIGVDGTVANCGVHGKPVEFDLDKLWIRNINVTTGLVSTNTTPQLLKALESHKIEPEKLVTHYFKLSEIEKAYEVFSKAADHHAIKVIIENDISEA

SEQ ID NO: 326 - protein, 383 aa, Streptococcus pneumoniae
MPNYIKADQFFYPHGVRRGGYLELVDGKFGKHVEQIPEGAEVIDYTGYSIAPGLVDTHIHGYAGVDVMDNNIEGTLHTMSEGLLSTGVTSFLPTTLTATYEQLLAVTENLGNHYKEATGAKIRGIYYEGPYFTETFKGAQNPTYMRDPGVEEFHSWQKAANGLLNKIALAPERDGVEDFVRTVTGEGVTVALGHSNATFDEAKKAIDAGASVWVHAYNGMRGLTHRELGMVGAMYQLPHTYAELICDGHHVDPKACEILIKQKGTENIALITDCMTAGGLEDGDYMLGEFPVVVANGTARLKSTGNLAGSILKLKDGLKNVVEWGIANPHEAVMMASFNPAKSVHIDDVCGQIREGYDADFIVLDKDLELVATYLDGVKRYQA

SEQ ID NO: 327 - protein, 605 aa, Streptococcus pneumoniae
MRIKWFSLIRIIGLLLVLLYHFFQTIFPGGFFGVDVFFTFSGFLITALLIEEFSKNNEIDLIGFFRRRFYRIVPPVVLMVLVTMPFTFLVRQDYVAGIGGQIAGVLGFMTNFYELLTGGSYESQFIPHLFVHNWSLAVEVHYYILWGLAVWFLSKQAKSNGQLKGMVFLLSAVAFLISFFSMFIGSFLVTSYSSVYFSSLTHVYPFFLGSMLATIVGVRQTTSLVKQLDKIWDLRKTLVVFGGGFGFLVLLTFFVKFTYLFAYLIGFLLASLAALAMILAARVLHEKTHHIQESKIISFLADTSYAVYLFHWPFYIIFSQLTSNLLAVLLTLICSYGFASLSFYVLEPWIAGKNTPIVQTLRPLPYIHAILAAGTGILTIIVCTVTLLAPQVGAFETDLTVNGLKQAATNIGQTKVMAERADANSLGIADGTMLIGDSVALRANTALQTALPGAQINAQVSVTTKTANEIMLNNSQNKFLPKTVVIATGVNNPENYKDDWDSIVKNLPKGHHMILVTPYEGDKTKETYAIVEKAAAYMRELAEKTPYITIADWNQVAKEHPEIWAGTDQVHFGSESSTIEAGAKLYADTIATALQTAQDKPVKSK

SEQ ID NO: 328 - protein, 370 aa, Streptococcus pneumoniae
MKKRMLLASTVALSFAPVLATQAEEVLWTARSVEQIQNDLTKTDNKTSYTVQYGDTLSTIAEALGVDVTVLANLNKITNMDLIFPETVLTTTVNEAEEVTEVEIQTPQADSSEEVTTATADLTTNQVTVDDQTVQVADLSQPIAEVTKTVIASEEVAPSTGTSVPEEQTTETTRPVEEATPQETTPAEKQETQASPQAASAVEVTTTSSEAKEVASSNGATAAVSTYQPEETKIISTTYEAPAAPDYAGLAVAKSENAGLQPQTAAFKEEIANLFGITSFSGYRPGDSGDHGKGLAIDFMVPERSELGDKIAEYAIQNMASRGISYIIWKQRFYAPFDSKYGPANTWNPMPDRGSVTENHYDHVHVSMNG

SEQ ID NO: 329 - protein, 206 aa, Streptococcus pneumoniae
MQKTAFIWDLDGTLLDSYEAILSGIEETFAQFSIPYDKEKVREFIFKYSVQDLLVRVAEDRNLDVEVLNQVRAQSLAEKNAQVVLMPGAREVLAWADESGIQQFIYTHKGNNAFTILKDLGVESYFTEILTSQSGFVRKPSPEAATYLLDKYQLNSDNTYYIGDRTLDVEFAQNSGIQSINFLESTYEGNHRIQALADISRIFETK

SEQ ID NO: 330 - protein, 494 aa, Streptococcus pneumoniae
MTLVYQSTRDANNTVTASQAILQGLATDGGLFTPDTYPKVDLNFDKLKDASYQEVAKLVLSAFLDDFTVEELDYCINNAYDSKFDTPAIAPLVKLDGQYNLELFHGSTIAFKDMALSILPYFMTTAAKKHGLENKIVILTATSGDTGKAAMAGFANVPGTEIIVFYPKDGVSKIQELQMTTQTGDNTHVIAIDGNFDDAQTNVKHMFNDVALREKLTTNKLQFSSANSMNIGRLVPQIVYYVYAYAQLVKTGEIVAGEKVNFTVPTGNFGNILAAFYAKQIGLPVGKLICASNDNNVLTDFFKTRVYDKKREFKVTTSPSMDILVSSNLERLIFHLLGNNAEKTTELMNALNTQGQYKLTDFDAEILDLFAAEYATEEETAAEIKRVCELDSYIEDPHTAVASAVYKKYQSATGDVTKTVIASTASPYKFPVVAVEAVTGKAGLTDFEALAQLHEISGVAVPPAVDGLEIAPIRHKTTVAAADMQAAVEAYLGL

SEQ ID NO: 331 - DNA, 4891 bp, Streptococcus pneumoniae
gctaagcgacttccctatctcacagggggcaacccccaactacttccggcgttctagggcttaacttctgtgttcggcatgggtacaggtgtatctcctaggctatcgtcacttaactctgagtaatacctactcaaaattgaatatctattcaatttaagaaaaccgttcgctttcatattctcagttactttggataagtcctcgagctattagtattagtccgctacatgtgtcgccacacttccacttctaacctatctacctgatcatctctcagggctcttactgatatataatcatgggaaatctcatcttgaggtgggtttcacacttagatgctttcagcgtttatcccttccctacatagctacccagcgatgcctttggcaagacaactggtacaccagcggtaagtccactctggtcctctcgtactaggagcagatcctctcaaatttcctacgcccgcgacggatagggaccgaactgtctcacgacgttctgaacccagctcgcgtgccgctttaatgggcgaacagcccaacccttgggaccgactacagccccaggatgcgacgagccgacatcgaggtgccaaacctccccgtcgatgtgaactcttgggggagataagcctgttatccccagggtagcttttatccgttgagcgatggcccttccatacggaaccaccggatcactaagcccgactttcgtccctgctcgagttgtagctctcgcagtcaagctcccttatacctttacactctgcgaatgatttccaaccattctgagggaacctttgggcgcctccgttaccttttaggaggcgaccgccccagtcaaactgcccgtcagacactgtctccgatagggatcacctatctgggttagagtggccataacacaagggtagtatcccaacagcgtctccttcgaaactggcgtcccgatctcttagactcctacctatcctgtacatgtggtacagacactcaatatcaaactgcagtaaagctccatggggtctttccgtcctgtcgcgggtaacctgcatcttcacaggtactaaaatttcaccgagtctctcgttgagacagtgcccaaatcattacgcctttcgtgcgggtcggaacttacccgacaaggaatttcgctaccttaggaccgttatagttacggccgccgtttactggggcttcaattcataccttcgcttacgctaagcactcctcttaaccttccagcaccgggcaggcgtcaccccctatacatcatcttacgatttagcagagagctgtgtttttgataaacagttgcttgggcctattcactgcggctgactttaagtcagcaccccttctcccgaagttacggggtcattttgccgagttccttaacgagagttctctcgctcacctgaggctactcgcctcgactacctgtgtcggtttgcggtacgggtagagtatgtttaaacgctagaagcttttcttggcagtgtgacgtcactaacttcgctactaaacttcgctccccatcacagctcaatgttatagaattaagcatttgactcaattcacacctcactgcttagacagactcttccaatcgtctgctttagttagcctactgcgtccctccatcactacatactctagtacaggaatatcaacctgttgtccatcggatacacctttcggtctctccttaggtcccgactaacccagggcggacgagccttcccctggaaaccttagtcttacggtggacaggattctcacctgtctttcgctactcataccggcattctcacttctatgcgttccagcactcctcacggtataccttcatcacacatagaacgctctcctaccatacctataaaggtatccacagcttcggtaaattgttttagccccggtacattttcggcgcagggtcactcgactagtgagctattacgcactctttgaatgaatagctgcttctaagctaacatcctagttgtctgtgcaaccccacatccttttccacttaacaattattttgggaccttagctggtggtctgggctgtttccctttcgactacggatcttagcactcgcagtctgactgccgaccataattcattggcattcggagtttatctgagattggtaatccgggatggacccctcacccaaacagtgctctacctccaagaatctctaatgtcgacgctagccctaaagctatttcggagagaaccagctatctccaagttcgtttggaatttctccgctacccacaagtcatccaagcacttttcaacgtgccctggttcggtcctccagtgcgtcttaccgcaccttcaacctgctcatgggtaggtcacatggtttcgggtctacgtcatgatactaaggcgccctattcagactcggtttccctacggctccgtctcttcaacttaacctcgcatcataacgtaactcgccggttcattctacaaaaggcacgctctcacccattaacgggctcgaacttgttgtaggcacacggtttcaggttctatttcactcccctcccggggtgcttttcacctttccctcacggtactggttcactatcggtcactagggagtatttagggttgggagatggtcctcccagattccgacgggatttcacgtgtcccgccgtactcaggatactgctaagtacaaagactattttaaatacgaggctattactctctttggctgatcttcccaaatcattcttctataatctttgagtccacattgcagtcctacaaccccgaagagtaaactcttcggtttgcccttctgccgtttcgctcgccgctactaaggcaatcgcttttgctttctcttcctgcagctacttagatgtttcagttcactgcgtcttcctcctcacatccttaacagatgtgggtaacaggtattacctgttgggttcccccattcggaaatccctggatcatcgcttacttacagctacccaaggcatatcgtcgtttgtcacgtccttcgtcggctcctagtgccaaggcatccaccgtgcgcccttattaacttaaccttattttctgacctttcagtcataaactcttattaatactacagcgttttcggtttattttcttgttactatttgatatagatattcaattttcaatgtgcattacttggtgatctctcaccaatggagcctagcgggatcgaaccgctgacctcctgcgtgcaaagcaggcgctctcccagctgagctaaggccccacaagacctctcaagactaaacaagaccaatgcgcagttccttatccttagaaaggaggtgatccagccgcaccttccgatacggctaccttgttacgacttcaccccaatcatctatcccaccttaggcggctggctccttacggttacctcaccgacttcgggtgttacaaactctcgtggtgtgacgggcggtgtgtacaaggcccgggaacgtattcaccgcggcgtgctgatccgcgattactagcgattccgacttcatgtaggcgagttgcagcctacaatccgaactgagactggctttaagagattagcttgccgtcaccggcttgcgactcgttgtaccagccattgtagcacgtgtgtagcccaggtcataaggggcatgatgatttgacgtcatccccaccttcctccggtttattaccggcagtctcgctagagtgcccaactaaatgatggcaactaacaataggggttgcgctcgttgcgggacttaacccaacatctcacgacacgagctgacgacaaccatgcaccacctgtcacctctgtcccgaaggaaagctctatctctagagcggtcagagggatgtcaagacctggtaaggttcttcgcgttgcttcgaattaaaccacatgctccaccgcttgtgcgggcccccgtcaattcctttgagtttcaaccttgcggtcgtactccccaggcggagtgcttaatgcgttagctacggcactaaaccccggaaagggtctaacacctagcactcatcgtttacagcgtggactaccagggtatctaatcctgtttgctccccacgctttcgagcctcagcgtcagttacaagccagagagccgctttcgccaccggtgttcctccatatatctacgcatttcaccgctacacatggaattccactctcccctcttgcactcaagttaaacagtttccaaagcctactatggttaagccacagcctttaacttcagacttatctaaccgcctgcgctcgctttacgcccaataaatccggacaacgctcgggacctacgtattaccgcggctgctggcacgtagttagccgtccctttctggtaagataccgtcacagtgtgaactttccactctcacactcgttcttctcttacaacagagctttacgatccgaaaaccttcttcactcacgcggcgttgctcggtcagacttccgtccattgccgaagattccctactgctgcctcccgtaggagtctgggccgtgtctcagtcccagtgtggccgatcaccctctcaggtcggctatgtatcgtcgccttggtgagccgttaccccaccaactagctaatacaacgcaggtccatctggtagtgatgcaagtgcaccttttaagcaaatgtcatgcaacatctactcttatgcggtattagctatcgtttccaatagttatcccccgctaccaggcaggttacctacgcgttactcacccgttcgcaactcatccagagaagcaagctcctccttcagcgttctacttgcatgtattaggcacgccgccagcgttcgtcctgagccaggatcaaactctcattaaaaag

SEQ ID NO: 332 - protein, 322 aa, Streptococcus pneumoniae
MRTLSKKKIMENKFVEFIENNKKVIISSVAVGVVLVLGFGWYSYNQQQAEQQAKIVQLEKDSKSDKEQVDKLFESFDASSDESISKLKELSETSLKTDAGKDYLNNKVKESSKAIVDFHLQKGLAYDVKDSDDKFKDKATLETNVKEITKQIDFIKKVDETFKQENLEETLKSLNDLVDKYQKQIELLKKEEEKAAEKAAEKAKESSSQSNSSGSASNESYNGSSNSNVDYSSSEQTNGYSNNYGGQDYSGSGDSSTNGGSSEQYSSSNSNSGANNVYRYKGTGADGYQRYYYKDHNNGDVYDDDGNYLGNFGGGIAEPSQR

SEQ ID NO: 333 - protein, 232 aa, Streptococcus pneumoniae
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGSVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 334 - protein, 190 aa, Streptococcus pneumoniae
MNKLMKFISVFLTSIVLIVSAIPSVSAVYASEQVSQIETNMELQPVTSLTEEQINTLANEIQSFHPDVSQQWIKEVINRQLQGDYTIPPTYSPFRAVWQGITVNQMGALLDTAIALALGGTTAGLANLIKVKGKHAAKSAIRSAISRYLGSWFVNDVALEFAMNLLSPGTYLAQLWDKNDAIPNNGRINF

SEQ ID NO: 335 - protein, 752 aa, Streptococcus pneumoniae
MLSLQEFVQNRYNKTIAECSNEELYLALLNYSKLASSQKPVNTGKKKVYYISAEFLIGKLLSNNLINLGLYDDVKKELAAAGKDLIEVEEVELEPSLGNGGLGRLAACFIDSIATLGLNGDGVGLNYHFGLFQQVLKNNQQETIPNAWLTEQNWLVRSSRSYQVPFADFTLTSTLYDIDVTGYETATKNRLRLFDLDSVDSSIIKDGINFDKTDIARNLTLFLYPDDSDRQGELLRIFQQYFMVSNGAQLIIDEAIEKGSNLHDLADYAVVQINDTHPSMVIPELIRLLTARGIDLDEAISIVRSMTAYTNHTILAEALEKWPLEFLQEVVPHLVPIIEELDRRVKAEYKDPAVQIIDESGRVHMAHMDIHYGYSVNGVAALHTEILKNSELKAFYDLYPEKFNNKTNGITFRRWLMHANPRLSHYLDEILGDGWHHEADELEKLLSYEDKAVVKEKLESIKAHNKRKLARHLKEHQGVEINPNSIFDIQIKRLHEYKRQQMNALYVIHKYLDIKAGNIPARPITIFFGGKAAPAYTIAQDIIHLILCMSEVIANDPAVAPHLQVVMVENYNVTAASFLIPACDISEQISLASKEASGTGNMKFMLNGALTLGTMDGANVEIAELVGEENIYIFGEDSETVIDLYAKAAYKSSEFYAREAIKPLVDFIVSDAVLAAGNKERLERFYNELINKDWFMTLLDLEDYIKVKEQMLADYEDRDAWLDKVIVNISKAGFFSSDRTIAQYNEDIWHLN

SEQ ID NO: 336 - protein, 228 aa, Streptococcus pneumoniae
RVVQKPFQWFDSVKSDLAHLTRTYNENESLKKQLYQLEVKSNEVESLKTENEQLRQLLDMKSKLQATKTLAADVIMRSPVSWKQELTLDAGRSKGASENMLAIANGGLIGSVSKVEENSTIVNLLTNTENADKISVKIQHGSTTIYGIIIGYDKENDVLKISQLNSNSDISAGDKVTTGGLGNFNVADIPVGEVVATTHSTDYLTREVTVKLSADTHNVDVIELVGNS

SEQ ID NO: 337 - protein, 262 aa, Streptococcus pneumoniae
LILEVTAVPVFSPTQSVEAVLVLLYDLTTIRTYEKLNLAFVSNASHELRTPVTSIKGFAETIKGMSAEEEALKDDFLDIIYKESLRLEHIVEHLLTLSKAQQMPIQWTTLSLAEFVQDLTQSLQPQLKKKDLQLKVQVPDDVTLVSDSQLLSQILLNLLSNAIRYTEQGGKIEVKTQKVNEGIKISVSDTGIGISQLEQDRIFERFYRVNKGRSRQTGGTGLGLAIVKELSQLLGGQVTVTSQLGRGSCFTIFLPNQSFAQD

SEQ ID NO: 338 - protein, 62 aa, Streptococcus pneumoniae
QKNRQEEAKILQKEEVLRVAKMALQTGQNQVSINGVEIQVFSSEKGLEVYHGSEQLLAIKEP

SEQ ID NO: 339 - protein, 112 aa, Streptococcus pneumoniae
SLASAVEALLAPLKRVKVPVHEIGLMLSMSLRFVPTLMDDTTRIMNAQKARGVDFGEGSIVQKVKAMIPILIPLFATSLKRADSLAIAMEARGYQGGKGRSQYRQLKWTLKD

SEQ ID NO: 340 - protein, 358 aa, Streptococcus pneumoniae
TQKSSVNNSNNNSTITQTAYKNENSTTQAVNKVKDAVVSVITYSANRQNSVFGNDDTDTDSQRISSEGSGVIYKKNDKEAYIVTNNHVINGASKVDIRLSDGTKVPGEIVGADTFSDIAVVKISSEKVTTVAEFGDSSKLTVGETAIAIGSPLGSEYANTVTQGIVSSLNRNVSLKSEDGQAISTKAIQTDTAINPGNSGGPLINIQGQVIGITSSKIATNGGTSVEGLGFAIPANDAINIIEQLEKNGKVTRPALGIQMVNLSNVSTSDIRRLNIPSNVTSGVVVRSVQSNMPANGHLEKYDVITKVDDKEIASSTDLQSALYNHSIGDTIKITYYRNGKEETTSIKLNKSSGDLES

SEQ ID NO: 341 - protein, 235 aa, Streptococcus pneumoniae
NSHKVQMEKEIALKQKKFEQKHLQNYTDEIVGLYNEIRGFRHDYAGMLVSMQMAIDSGNLQEIDRIYNEVLVKANHKLRSDKYTYFDLNNIEDSALRSLVAQSIVYARNNGVEFTLEVKDTITKLPIELLDLVRIMSVLLNNAVEGSADSYKKQMEVAVIKMETETVIVIQNSCKMTMTPSGDLFALGFSTKGRNRGVGLNNVKELLDKYNNIILETEMEGSTFRQIIRFKREFE

What is claimed is:

1. An immunogenic composition comprising:
   (a) at least one isolated cold spot extracellular domain consisting of the amino acid sequence of SEQ ID NO:338;
   (b) a pharmaceutically acceptable vehicle or excipient; and
   (c) an effective amount of adjuvant;
   wherein said composition is capable of eliciting an immune response against Streptococcus pneumoniae in a mammal.

2. The immunogenic composition of claim 1, wherein said composition further comprises at least one additional immunogen (d) comprising a cold spot polypeptide that is a Streptococcus pneumoniae surface protein or an isolated cold spot extracellular domain thereof.

3. The immunogenic composition of claim 2, wherein said at least one additional immunogen (d) is an isolated cold spot extracellular domain having an amino acid sequence selected from the group consisting of SEQ ID NO:336, SEQ ID NO:337, SEQ ID NO:339, SEQ ID NO:340, SEQ ID NO:341, or combinations thereof.

4. A method of eliciting an immune response in a mammal, said method comprising administering to said mammal an immunogenic composition according to claim 1.

5. The method of claim 4, wherein said mammal is a human.

6. A method of immunizing a subject against S. pneumoniae infection, said method comprising administering at least one immunogenic composition according to claim 1 to a subject in an amount or for a number of administrations sufficient to elicit an immune response including antibodies recognizing a majority of the known serotypes of S. pneumoniae capsular serotypes.

7. The method according to claim 6, wherein said administration elicits an immune response including antibodies recognizing 80 S. pneumoniae capsular serotypes.

8. The method according to claim 7, wherein said administration elicits an immune response including antibodies recognizing 90 S. pneumoniae capsular serotypes.

9. A method of making an immunogenic composition for raising an immune response producing antibodies reactive against a majority of the known serotypes of S. pneumoniae, said method comprising:
   (1) formulating an isolated cold spot extracellular domain consisting of the amino acid sequence of SEQ ID NO:338 with a pharmaceutically acceptable carrier and an effective amount of adjuvant, to produce an immunogenic composition for inoculating human subjects against S. pneumoniae infection.

10. The method according to claim 9, wherein said formulating step (1) further includes adding an additional immunogen comprising a cold spot polypeptide that is a Streptococcus pneumoniae surface protein or an isolated cold spot extracellular domain thereof.

11. The method according to claim 9, wherein said immunogenic composition is effective for raising an immune response producing antibodies reactive with 80 S. pneumoniae serotypes.

12. The method according to claim 9, wherein said immunogenic composition is effective for raising an immune response producing antibodies reactive with 90 S. pneumoniae serotypes.

13. The method according to claim 9, wherein said immunogenic composition is effective for raising an immune response producing antibodies reactive with 93 S. pneumoniae serotypes.

* * * * *